(12) United States Patent
Schøller et al.

(10) Patent No.: US 10,369,204 B2
(45) Date of Patent: Aug. 6, 2019

(54) MOLECULAR VACCINES FOR INFECTIOUS DISEASE

(75) Inventors: Jørgen Schøller, Lyngby (DK); Henrik Pedersen, Lynge (DK); Liselotte Brix, Bagsværd (DK)

(73) Assignee: Dako Denmark A/S, Glostrup (DK)

( * ) Notice: Subject to any disclaimer, the term of this patent is extended or adjusted under 35 U.S.C. 154(b) by 494 days.

(21) Appl. No.: 13/122,007

(22) PCT Filed: Oct. 2, 2009

(86) PCT No.: PCT/DK2009/050262
§ 371 (c)(1),
(2), (4) Date: Jun. 29, 2012

(87) PCT Pub. No.: WO2010/037402
PCT Pub. Date: Apr. 8, 2010

(65) Prior Publication Data
US 2012/0258126 A1    Oct. 11, 2012

Related U.S. Application Data

(60) Provisional application No. 61/102,126, filed on Oct. 2, 2008.

(30) Foreign Application Priority Data

Oct. 2, 2008   (DK) ................................ 2008 01384

(51) Int. Cl.
| | | |
|---|---|---|
| A61K 39/00 | (2006.01) |
| A61K 39/21 | (2006.01) |
| A61K 39/12 | (2006.01) |
| A61K 47/61 | (2017.01) |
| C07K 14/74 | (2006.01) |
| A61K 47/64 | (2017.01) |
| A61K 38/00 | (2006.01) |

(52) U.S. Cl.
CPC ............. *A61K 39/00* (2013.01); *A61K 39/12* (2013.01); *A61K 39/21* (2013.01); *A61K 47/61* (2017.08); *A61K 47/646* (2017.08); *C07K 14/70539* (2013.01); *A61K 38/00* (2013.01); *A61K 2039/5154* (2013.01); *A61K 2039/54* (2013.01); *A61K 2039/545* (2013.01); *A61K 2039/55505* (2013.01); *A61K 2039/55516* (2013.01); *A61K 2039/55583* (2013.01); *A61K 2039/6087* (2013.01); *A61K 2039/625* (2013.01); *C12N 2740/16134* (2013.01); *C12N 2740/16234* (2013.01); *Y02A 50/464* (2018.01)

(58) Field of Classification Search
None
See application file for complete search history.

(56) References Cited

U.S. PATENT DOCUMENTS

| | | |
|---|---|---|
| 4,281,061 A | 7/1981 | Zuk et al. |
| 4,336,173 A | 6/1982 | Ugelstad |
| 4,387,164 A | 6/1983 | Hevey et al. |
| 4,459,378 A | 7/1984 | Ugelstad |
| 4,654,267 A | 3/1987 | Ugelstad et al. |
| 4,876,190 A | 10/1989 | Recktenwald |
| 5,039,487 A | 8/1991 | Smith |
| 5,130,297 A | 7/1992 | Sharma et al. |
| 5,194,425 A | 3/1993 | Sharma et al. |
| 5,260,422 A | 11/1993 | Clark et al. |
| 5,284,935 A | 2/1994 | Clark et al. |
| 5,312,744 A | 5/1994 | Shibata |
| 5,468,481 A | 11/1995 | Sharma et al. |
| 5,583,031 A | 12/1996 | Stern |
| 5,627,037 A | 5/1997 | Ward et al. |
| 5,635,363 A | 7/1997 | Altman et al. |
| 5,652,342 A | 7/1997 | Zimmerman et al. |
| 5,807,552 A | 9/1998 | Stanton et al. |
| 5,869,270 A | 2/1999 | Rhode et al. |
| 5,891,741 A | 4/1999 | Siiman et al. |
| 5,955,079 A | 9/1999 | Mond et al. |
| 5,994,089 A | 11/1999 | Siiman et al. |
| 5,998,204 A | 12/1999 | Tsien et al. |
| 6,015,884 A | 1/2000 | Schneck et al. |
| 6,096,315 A | 1/2000 | Zimmerman et al. |

(Continued)

FOREIGN PATENT DOCUMENTS

| | | |
|---|---|---|
| DE | 197 40 735 | 3/1999 |
| DE | 102 47 014 | 4/2004 |

(Continued)

OTHER PUBLICATIONS

Nepom et al., 2003. MHC multimers: expanding the clinical tool kit. Clinical Immunology 106 (2003) 1-4.*
Matthews TJ, Lyerly HK, Weinhold KJ, Langlois AJ, Rusche J, Putney SD, GalloRC, Bolognesi DP. Prospects for development of a vaccine against HTLV-III-related disorders. AIDS Res Hum Retroviruses. 1987;3 Suppl 1:197-206.*
Desrosiers RC. Prospects for an AIDS vaccine. Nat Med. Mar. 2004;10(3):221-3.*

(Continued)

*Primary Examiner* — Benjamin P Blumel
(74) *Attorney, Agent, or Firm* — Arent Fox LLP

(57) ABSTRACT

The present invention relates to methods for construction of pharmamers i.e. vaccine components characterized by their multimerization domain and the attached biologically active molecules, and their use in preparation of vaccines that contains the pharmamers alone or in combination with other molecules. The individual molecules of the construct can be bound to each other or the multimerization domain(s) by covalent or non-covalent bonds, directly or via linkers. The invention further relates to the use of such preparations in vaccine settings aimed to function as preventive/prophylactic or therapeutic vaccines in humans and animals.

18 Claims, 60 Drawing Sheets

Figure 3:
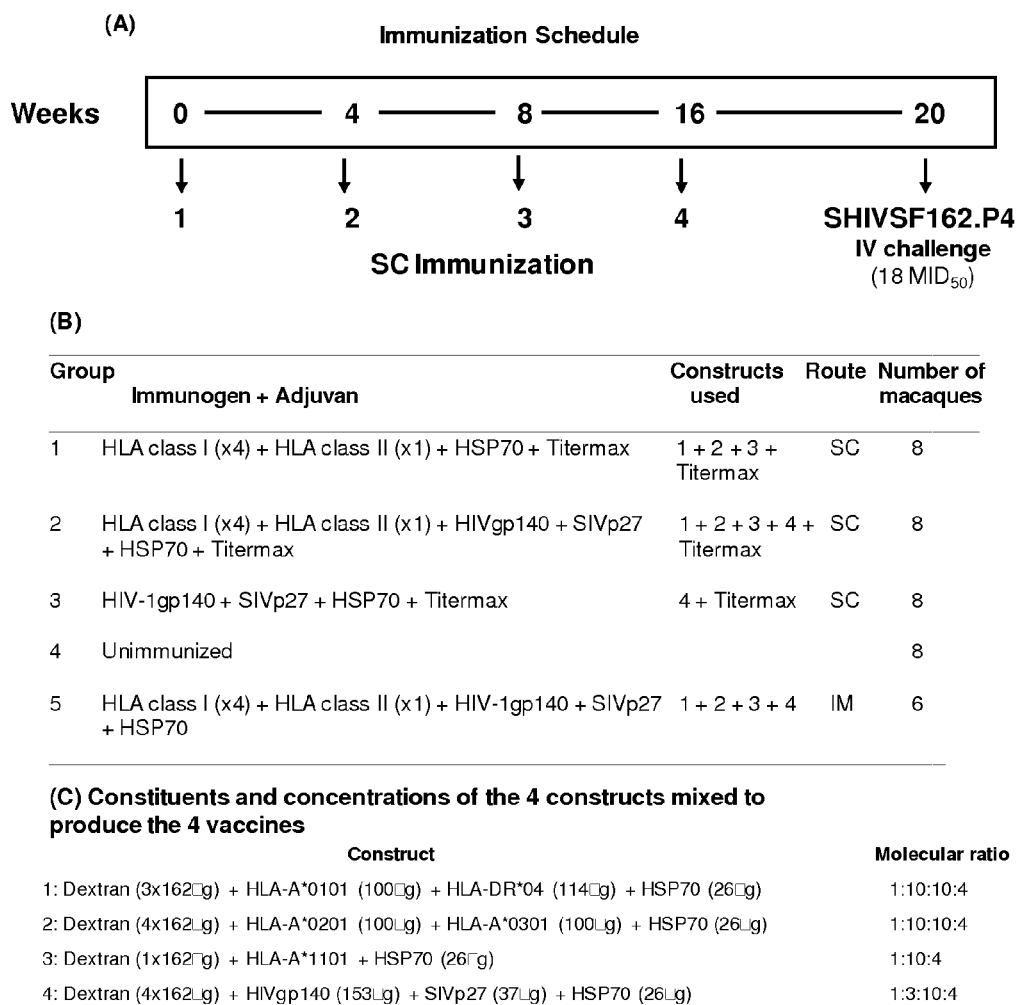

Specification includes a Sequence Listing.

(56) References Cited

U.S. PATENT DOCUMENTS

| | | | |
|---|---|---|---|
| 6,156,317 A | 5/2000 | Diamond et al. | |
| 6,074,645 A | 6/2000 | Diamond et al. | |
| 6,090,587 A | 7/2000 | Rhode et al. | |
| 6,106,840 A | 8/2000 | Clark et al. | |
| 6,129,916 A | 10/2000 | Chang | |
| 6,140,113 A | 10/2000 | Schneck et al. | |
| 6,156,514 A | 12/2000 | Acevedo et al. | |
| 6,197,302 B1 | 3/2001 | Hirsch et al. | |
| 6,197,928 B1 | 3/2001 | Tsien et al. | |
| 6,211,342 B1 | 4/2001 | Hirsch et al. | |
| 6,232,445 B1 | 5/2001 | Rhode et al. | |
| 6,248,564 B1 | 6/2001 | Walter et al. | |
| 6,251,399 B1 | 6/2001 | Diamond et al. | |
| 6,268,411 B1 | 7/2001 | Schneck et al. | |
| 6,306,605 B1 | 10/2001 | Acevedo et al. | |
| 6,309,645 B1 | 10/2001 | Rhode et al. | |
| 6,335,173 B1 | 1/2002 | Kaplan | |
| 6,387,622 B1 | 5/2002 | Siiman et al. | |
| 6,448,071 B1 | 9/2002 | Schneck et al. | |
| 6,451,314 B1 | 9/2002 | Clark et al. | |
| 6,451,769 B1 | 9/2002 | Huebner et al. | |
| 6,458,354 B1 | 10/2002 | Schneck et al. | |
| 6,458,933 B1 | 10/2002 | Hansen | |
| 6,486,130 B1 | 11/2002 | Livey et al. | |
| 6,517,838 B1 | 2/2003 | Hook et al. | |
| 6,534,633 B1 | 3/2003 | Weidanz et al. | |
| 6,548,067 B1 | 4/2003 | Seeman et al. | |
| 6,605,711 B1 | 8/2003 | Valmori et al. | |
| 6,734,013 B2 | 5/2004 | Schneck et al. | |
| 7,041,442 B1 | 5/2006 | Kern et al. | |
| 7,060,869 B2 | 6/2006 | Tsien et al. | |
| 7,064,190 B1 | 6/2006 | Endl et al. | |
| 7,074,904 B2 | 6/2006 | Wong et al. | |
| 7,094,555 B2 | 8/2006 | Kwok et al. | |
| 7,116,407 B2 | 10/2006 | Hansen et al. | |
| 7,141,656 B2 | 11/2006 | Rhode et al. | |
| 7,202,349 B2 | 4/2007 | Davis et al. | |
| 7,364,869 B2 | 4/2008 | Nixon et al. | |
| 7,502,580 B2 | 3/2009 | Hays | |
| 7,519,318 B2 | 4/2009 | Kurogawa et al. | |
| 7,524,503 B2 | 4/2009 | Khanna et al. | |
| 7,706,782 B1 | 4/2010 | Hosmer et al. | |
| 7,902,121 B2 | 3/2011 | Chen et al. | |
| 8,114,669 B2 | 2/2012 | Choo | |
| 8,268,964 B2 * | 9/2012 | Scholler et al. | 530/350 |
| 8,298,782 B2 | 10/2012 | Busch et al. | |
| 2002/0006903 A1 | 1/2002 | Schneck et al. | |
| 2002/0034513 A1 | 3/2002 | Rhode et al. | |
| 2002/0058787 A1 | 5/2002 | Strominger et al. | |
| 2002/0082411 A1 | 6/2002 | Carter et al. | |
| 2002/0091079 A1 | 7/2002 | Rhode et al. | |
| 2002/0119149 A1 | 8/2002 | Jakobsen et al. | |
| 2002/0127231 A1 | 9/2002 | Schneck et al. | |
| 2002/0164340 A1 | 11/2002 | Brumeanu et al. | |
| 2002/0165364 A1 | 11/2002 | Tsien et al. | |
| 2002/0198144 A1 | 12/2002 | Wong et al. | |
| 2003/0017447 A1 | 1/2003 | Bernardo et al. | |
| 2003/0027194 A1 | 2/2003 | Kurz et al. | |
| 2003/0073102 A1 | 4/2003 | Kwok et al. | |
| 2003/0096432 A1 | 5/2003 | Jakobsen | |
| 2003/0104635 A1 | 6/2003 | Jakobsen | |
| 2003/0118594 A1 | 6/2003 | Nag et al. | |
| 2003/0171290 A1 | 9/2003 | Carr et al. | |
| 2003/0199438 A1 | 10/2003 | Shaw et al. | |
| 2003/0228258 A1 | 12/2003 | Scheinberg et al. | |
| 2004/0068100 A1 | 4/2004 | Mach et al. | |
| 2004/0072262 A1 | 4/2004 | Montero-Julian et al. | |
| 2004/0082012 A1 | 4/2004 | Busch et al. | |
| 2004/0086520 A1 | 5/2004 | Diamond | |
| 2004/0137642 A1 | 7/2004 | Erfle et al. | |
| 2004/0141958 A1 | 7/2004 | Steinaa et al. | |
| 2004/0143094 A1 | 7/2004 | Donda et al. | |
| 2004/0204565 A1 | 10/2004 | Schneck et al. | |
| 2004/0209295 A1 | 10/2004 | Schwabe et al. | |
| 2004/0209314 A1 | 10/2004 | Lang et al. | |
| 2004/0223977 A1 | 11/2004 | Diamond | |
| 2004/0253632 A1 | 12/2004 | Rhode et al. | |
| 2005/0003431 A1 | 1/2005 | Wucherpfennig et al. | |
| 2005/0074822 A1 | 4/2005 | Nixon et al. | |
| 2005/0074848 A1 | 4/2005 | Schwabe | |
| 2005/0079152 A1 | 4/2005 | Bot et al. | |
| 2005/0095655 A1 | 5/2005 | Montero-Julian et al. | |
| 2005/0208529 A1 | 9/2005 | Winther et al. | |
| 2005/0214284 A1 | 9/2005 | Price-Schiavi et al. | |
| 2005/0214852 A1 | 9/2005 | Gaynor et al. | |
| 2005/0239160 A1 | 10/2005 | Shaw et al. | |
| 2006/0018878 A1 | 1/2006 | Cooper et al. | |
| 2006/0018929 A1 | 1/2006 | Zaia et al. | |
| 2006/0073159 A1 * | 4/2006 | Vonderheide et al. | 424/185.1 |
| 2006/0078563 A1 * | 4/2006 | Srivastava | A61K 38/1709 424/185.1 |
| 2006/0084116 A1 | 4/2006 | Muchhal | |
| 2006/0112440 A1 | 5/2006 | Tsien et al. | |
| 2006/0141540 A1 | 6/2006 | Miltenyi et al. | |
| 2006/0155115 A1 | 7/2006 | Jakobsen et al. | |
| 2006/0166214 A1 | 7/2006 | Kato et al. | |
| 2006/0166875 A1 | 7/2006 | Jakobsen et al. | |
| 2006/0171954 A1 | 8/2006 | Endl et al. | |
| 2006/0228758 A1 | 10/2006 | Muchhal et al. | |
| 2006/0228759 A1 | 10/2006 | Muchhal et al. | |
| 2006/0234309 A1 | 10/2006 | Shankar et al. | |
| 2006/0234310 A1 | 10/2006 | Cai et al. | |
| 2006/0240482 A1 | 10/2006 | Kwok et al. | |
| 2007/0026503 A1 | 2/2007 | Lacey | |
| 2007/0134814 A1 | 6/2007 | Kajander et al. | |
| 2007/0154953 A1 | 7/2007 | Brunner et al. | |
| 2007/0178532 A1 | 8/2007 | Jacobson et al. | |
| 2007/0184022 A1 * | 8/2007 | Wang et al. | 424/85.2 |
| 2007/0280957 A1 | 12/2007 | Falk et al. | |
| 2008/0219947 A1 | 9/2008 | Linette et al. | |
| 2009/0004213 A1 | 1/2009 | Singh et al. | |
| 2009/0061478 A1 | 3/2009 | Poulsen et al. | |
| 2009/0232766 A1 * | 9/2009 | Wang et al. | 424/85.2 |
| 2009/0324630 A1 | 12/2009 | Jensen | |
| 2010/0159594 A1 | 6/2010 | Hansen et al. | |
| 2010/0168390 A1 * | 7/2010 | Brix et al. | 530/350 |
| 2010/0226854 A1 * | 9/2010 | Scholler et al. | 424/1.69 |
| 2011/0212090 A1 * | 9/2011 | Pedersen et al. | 424/133.1 |
| 2011/0236411 A1 * | 9/2011 | Scholler et al. | 424/193.1 |
| 2011/0318380 A1 * | 12/2011 | Brix et al. | 424/193.1 |
| 2012/0020998 A1 | 1/2012 | Plumes et al. | |
| 2012/0264161 A1 * | 10/2012 | Scholler et al. | 435/29 |
| 2015/0329617 A1 * | 11/2015 | Winther | C07K 14/70539 436/518 |

FOREIGN PATENT DOCUMENTS

| | | |
|---|---|---|
| EP | 0 106 873 | 5/1984 |
| EP | 0 352 761 | 1/1990 |
| EP | 0 516 953 | 12/1992 |
| EP | 0 633 028 | 1/1995 |
| EP | 0 636 696 | 2/1995 |
| EP | 0 420 913 | 11/1995 |
| EP | 0 423 201 | 6/1996 |
| EP | 0 742 014 | 11/1996 |
| EP | 0 949 508 | 10/1999 |
| EP | 0946592 | 10/1999 |
| EP | 1023319 | 8/2000 |
| EP | 0 776 339 | 10/2000 |
| EP | 1 051 619 | 11/2000 |
| EP | 1181313 | 2/2002 |
| EP | 0 981 747 | 7/2002 |
| EP | 1 227 321 | 7/2002 |
| EP | 0 630 255 | 12/2002 |
| EP | 0 812 331 | 5/2004 |
| EP | 0 935 607 | 7/2004 |
| EP | 1 437 366 | 7/2004 |
| EP | 0 877 760 | 9/2004 |
| EP | 1 526 141 | 8/2005 |
| EP | 0 997 477 | 3/2006 |
| EP | 1 017 799 | 3/2006 |
| EP | 1 349 569 | 4/2007 |
| EP | 0 665 289 | 5/2007 |
| EP | 1 012 320 | 10/2007 |

(56) References Cited

FOREIGN PATENT DOCUMENTS

| | | |
|---|---|---|
| RU | 2 260 047 | 4/2005 |
| WO | WO 89/12458 | 12/1989 |
| WO | WO 89/12459 | 12/1989 |
| WO | WO 90/04411 | 5/1990 |
| WO | WO 91/09870 | 7/1991 |
| WO | WO 91/15766 | 10/1991 |
| WO | WO 92/00055 | 1/1992 |
| WO | WO 92/08983 | 5/1992 |
| WO | WO 92/18150 | 10/1992 |
| WO | WO 92/21972 | 12/1992 |
| WO | WO 93/01498 | 1/1993 |
| WO | WO 93/04175 | 3/1993 |
| WO | WO 93/08306 | 4/1993 |
| WO | WO 93/10220 | 5/1993 |
| WO | WO 94/11078 | 5/1994 |
| WO | WO 94/12196 | 6/1994 |
| WO | WO 95/11998 | 5/1995 |
| WO | WO 95/12676 | 5/1995 |
| WO | WO 95/14781 | 6/1995 |
| WO | WO 96/04314 | 2/1996 |
| WO | WO1996/26962 A1 * | 2/1996 |
| WO | WO 96/26962 | 9/1996 |
| WO | WO 97/05239 | 2/1997 |
| WO | WO 97/28191 | 8/1997 |
| WO | WO 97/35991 | 10/1997 |
| WO | WO 97/42221 | 11/1997 |
| WO | WO 97/44667 | 11/1997 |
| WO | WO 98/03552 | 1/1998 |
| WO | WO 98/05965 | 2/1998 |
| WO | WO 98/06749 | 2/1998 |
| WO | WO 98/05684 | 5/1998 |
| WO | WO 1999/002183 | 1/1999 |
| WO | WO 99/11661 | 3/1999 |
| WO | WO 99/11775 | 3/1999 |
| WO | WO 99/14236 | 3/1999 |
| WO | 1999024577 A1 | 5/1999 |
| WO | WO 99/21572 | 5/1999 |
| WO | WO1999024577 A1 | 5/1999 |
| WO | WO 99/13095 | 7/1999 |
| WO | WO 1999/36568 | 7/1999 |
| WO | WO 99/42597 | 8/1999 |
| WO | WO 99/50637 | 10/1999 |
| WO | WO 99/58557 | 11/1999 |
| WO | WO 99/60119 | 11/1999 |
| WO | WO 2000/006745 | 2/2000 |
| WO | WO 2000/015665 | 3/2000 |
| WO | 2000021989 | 4/2000 |
| WO | WO 2000/023053 | 4/2000 |
| WO | WO200021989 A1 | 4/2000 |
| WO | WO 2000/075180 | 12/2000 |
| WO | WO 2000/078966 | 12/2000 |
| WO | WO 2003/000720 | 1/2001 |
| WO | WO 2001/63286 | 8/2001 |
| WO | 2001073443 A3 | 10/2001 |
| WO | WO 2001/072782 | 10/2001 |
| WO | WO 2001/72782 | 10/2001 |
| WO | WO2001073443 A3 | 10/2001 |
| WO | WO 2001/070245 | 11/2001 |
| WO | WO 2001/080833 | 11/2001 |
| WO | WO 2001/090198 | 11/2001 |
| WO | WO 2001/090747 | 11/2001 |
| WO | WO 2002/016422 | 2/2002 |
| WO | WO 2002/054065 | 7/2002 |
| WO | WO 2002/072631 | 9/2002 |
| WO | WO2002072631 A2 * | 9/2002 |
| WO | WO 2002/089837 | 11/2002 |
| WO | WO 03/016905 | 2/2003 |
| WO | WO 2002/055992 | 3/2003 |
| WO | WO 2003/073097 | 9/2003 |
| WO | WO 2002/083906 | 10/2003 |
| WO | WO 2003/101473 | 12/2003 |
| WO | WO 2004/000873 | 12/2003 |
| WO | WO 2004/014957 | 2/2004 |
| WO | WO 2004-018520 | 3/2004 |
| WO | WO 2004-033497 | 4/2004 |
| WO | WO 2004/093905 | 11/2004 |
| WO | WO 2005/002621 | 1/2005 |
| WO | WO 2005/007689 | 1/2005 |
| WO | WO 2005/035567 | 4/2005 |
| WO | WO 2005/049073 | 6/2005 |
| WO | WO 2005/116051 | 12/2005 |
| WO | WO 2006/009838 | 1/2006 |
| WO | WO 2006/014292 | 2/2006 |
| WO | WO 2006/056027 | 6/2006 |
| WO | WO 2006/071990 | 7/2006 |
| WO | WO 2006/081826 | 8/2006 |
| WO | WO 2006/082387 | 8/2006 |
| WO | WO 2006/090283 | 8/2006 |
| WO | WO 2006/113622 | 10/2006 |
| WO | 2007015168 A2 | 2/2007 |
| WO | WO 2007/065098 | 6/2007 |
| WO | WO 2007/085266 | 8/2007 |
| WO | WO 2007/136778 | 11/2007 |
| WO | WO 2008/019366 | 2/2008 |
| WO | WO 2008/031133 | 3/2008 |
| WO | WO 2008/116468 | 10/2008 |
| WO | WO 2009/003492 | 1/2009 |
| WO | WO 2009/003493 | 1/2009 |
| WO | WO 2009/039854 | 4/2009 |
| WO | 2009077173 A2 | 6/2009 |
| WO | WO 2009/106073 | 9/2009 |
| WO | WO 2009/114207 | 9/2009 |
| WO | 2009126828 A2 | 10/2009 |
| WO | WO 2009/125231 | 10/2009 |
| WO | WO 2009/126816 | 10/2009 |
| WO | WO 2009/155535 | 11/2009 |
| WO | WO 2010/009735 | 1/2010 |
| WO | WO 2010/032022 | 3/2010 |
| WO | WO 2010/037395 | 4/2010 |
| WO | WO 2010/037397 | 4/2010 |
| WO | WO 2010/037402 | 4/2010 |
| WO | 2012044999 A2 | 4/2012 |
| WO | 2012094492 A2 | 7/2012 |

OTHER PUBLICATIONS

Greten TF, Korangy F, Neumann G, Wedemeyer H, Schlote K, Heller A, Scheffer S, Pardoll DM, Garbe AI, Schneck JP, Manns MP. Peptide-beta2-microglobulin-MHC fusion molecules bind antigen-specific T cells and can be used for multivalent MHC-Ig complexes. J Immunol Methods. Dec. 20, 2002;271(1-2):125-35.*

Bakker AH, Schumacher TN. MHC multimer technology: current status and future prospects. Curr Opin Immunol. Aug. 2005;17(4):428-33. Review.*

Hackett CJ, Sharma OK. Frontiers in peptide-MHC class II multimer technology. Nat Immunol. Oct. 2002;3(10):887-9.*

Neudorfer J, Schmidt B, Huster KM, Anderl F, Schiemann M, Holzapfel G, Schmidt T, Germeroth L, Wagner H, Peschel C, Busch DH, Bernhard H. Reversible HLA multimers (Streptamers) for the isolation of human cytotoxic T lymphocytes functionally active against tumor- and virus-derived antigens. J Immunol Methods. Mar. 30, 2007;320(1-2):119-31. Epub 2007 J.*

Xu L, Zha Q, Sun H, Jia Q, Li F, He X. Preparation and characterization of HLA-A*0201 tetramer loaded with IE-1316-324 antigenic peptide of human cytomegalovirus. Cell Mol Immunol. Oct. 2006;3(5):367-71.*

Bauer SM, Williams MA, Howell AP, Schwarz E, Smith ES, Zauderer M. Maximizing immune responses: the effects of covalent peptide linkage to beta-2-microglobulin. Oncol Res. 2008;17(5):205-16.*

Yang GB, et. al. Immunization with recombinant macaque major histocompatibility complex class I and II and human immunodeficiency virus gp140 inhibits simian-human immunodeficiency virus infection in macaques. J Gen Virol. Jul. 2012;93(Pt7):1506-18. Epub Apr. 4, 2012.*

Batard P, Peterson DA, Devevre E, Guillaume P, Cerottini JC, Rimoldi D, Speiser DE, Winther L, Romero P. Dextramers: new generation of fluorescent MHC class I/peptide multimers for visualization of antigen-specific CD8+ T cells. J Immunol Methods. Mar. 20, 2006;310(1-2):136-48. Epub Feb. 17, 2006.*

(56) References Cited

OTHER PUBLICATIONS

Deng XL, Chen W, Cai MY, Wei DP. Expression of class I MHC molecule, HSP70 and TAP in human hepatocellular carcinoma. World J Gastroenterol. Aug. 2003;9(8):1853-5; p. 1855.*
Altman JD, Moss PA, Goulder PJ, Barouch DH, McHeyzer-Williams MG, Bell JI, McMichael AJ, Davis MM. Phenotypic analysis of antigen-specific T lymphocytes. Science. Oct. 4, 1996;274(5284):94-6. Erratum in: Science Jun. 19, 1998;280(5371):1821.*
Demma LJ, Logsdon JM, Vanderford TH, Feinberg MB, Staprans SI. gag protein, partial [Simian immunodeficiency virus]. GenBank: AAU33994.1. Dep. Sep. 20, 2005.*
Sueltmann H, Murray BW, Klein J.Hsp70 [Danio rerio]. GenBank: AAF70445.1. Dep. Dec. 22, 2000.*
Microspheres-Nanospheres.com. "Magnetic Streptavidin Coated Dextran nanospheres and microspheres." Copyright 2006. http://www.microspheres-nanospheres.com/Microspheres/Magnetic/Dex%20Mag%20Streptavidin.htm. Cold Spring, NY.*
Jordan KR, McMahan RH, Oh JZ, Pipeling MR, Pardoll DM, Kedl RM, Kappler JW, Slansky JE. Baculovirus-infected insect cells expressing peptide-MHC complexes elicit protective antitumor immunity. J Immunol. Jan. 1, 2008;180(1):188-97.*
U.S. Appl. No. 12/619,039, filed Nov. 16, 2009, Jorgen Scholler.
U.S. Appl. No. 12/644,554, filed Dec. 22, 2009, Liselotte Brix.
U.S. Appl. No. 12/647,747, filed Dec. 18, 2009, Kivin Jacobsen.
U.S. Appl. No. 12/680,248, filed Mar. 26, 2010, Jorgen Scholler.
U.S. Appl. No. 12/919,405, filed Aug. 25, 2010, Jorgen Scholler.
U.S. Appl. No. 13/055,321, filed Jan. 21, 2011, Henrik Pedersen.
U.S. Appl. No. 13/122,027, filed Mar. 31, 2011, Liselotte Brix.
Alp, et al., "Fine specificity of cellular immune responses in humans to human cytomegalovirus immediate-early 1 protein", Journal of Virology, vol. 65, No. 9, 1991 pp. 4812-4820.
Bleesing, et al., "Cell Function-Based Flow Cytometry" Seminars in Hematology, Apr. 2001, pp. 169-178, vol. 38, No. 2.
Bross, et al., "Approval summary: Gemtuzumab ozogamicin in relapsed acute myeloid leukemia", Clin. Cancer Res., 2001, 7:1490-1496.
Cecconi, et al., "Use of MHC Class II Tetramers to Investigate CD4 + T Cell Responses: Problems and Solutions," Cytometry, 2008, Part A 73, No. 11, pp. 1010-10018.
Chattopadhyay, et al., "Techniques to improve the direct Ex Vivo detection of low frequency antigen-specific CD8+T cells with peptide-major histocompatibility complex class I tetramers," Cytometry, 2008, Part A, vol. 73, pp. 1001-1009.
Drouin, et al., "Molecular Characterization of the OspA161-175 T cell epitope associated with the treatment-resistant Lyme Arthritis: difference among the three pathogenic species of Borrelia burgdorferu sensu lato", Journal of Autoimmunity, 2004, vol. 23, No. 3, pp. 281-292.
Ferré, et al., "Purification of correctly oxidized MHC class I heavy-chain molecules under denaturing conditions: A novel strategy exploiting disulfide assisted protein folding", Protein Science, 2003, 12, pp. 551-559.
Fornas, et al., Flow Cytometry Counting of CD34+ cells in whole blood, Nature Medicine, 6 (2000) 7:833-836.
Heijnen, et al., "Enumeration of Antigen-Specific CD8+ T Lymphocytes by Single-Platform, HLA Tetramer-Based Flow Cytometry: A European Multicenter Evaluation", Clinical Cytometry, 2004, pp. 1-13, vol. 62B.
International Search report dated May 6, 2007 in International Application No. PCT/DK2007/000045.
Lissina, et al., "Protein Kinase Inhibitors Substantially Improve the Physical Detection of T-Cells with Peptide-MHC Tetramers," J. Immunol. Methods, 2009, vol. 340, pp. 11-24.
Maloney, et al., "IDEC-C2B8 (Rituximab) anti-CD20 monoclonal antibody therapy in patients with relapsed low-grade non-Hodgkin's lymphoma," Sep. 1997, Blood, 90 (6):21:88-2195.
Melenhorst, et al.,"Detection of Low Avidity CD8+ T Cell Populations with Coreceptor-Enhanced Peptide-Major Histocompatibility Complex Class I Tetramers," J. Immunol. Methods, 2008, vol. 338, No. 1-2, pp. 31-39.
Vollers, et al., "Class II Major Histocompatibility Complex Tetramer Staining: Progress, Problems, and Prospects," Immunology, 2008, vol. 123, pp. 305-313.
Weichsel, et al., "Profound Inhibition of Antigen-Specific T-Cell Effector Functions by Dasatinib," Clin. Cancer Res.2008, vol. 14, pp. 2484-2491.
Wolfl, et al., "Quantitation of MHC Tetramer-Positive Cells From Whole Blood: Evaluation of Single-Platform, Six-parameter Flow Cytometric Method", Cytometry Part A, 2004, pp. 120-130, vol. 57A.
Akiyama, "Analysis of HLA-A24-restricted CMVpp65 peptide-specific CTL with HLA-A*2402-CMVpp65 tetramer," Immunology Letters, vol. 95, Issue 2, pp. 199-205 (2004).
Busch, "Detection of Borrelia burgdorferi-Specific CD8+ Cytotoxic T Cells in Patients with Lyme Arthritis," The Journal of Immunology, vol. 157, No. 8, pp. 3534-3541 (1996).
Celis, "Identification of potential CTL Epitopes of Tumor-Associated Antigen Mage-1 for Five Common HLA-A Alleles," Molecular Immunology, vol. 31, No. 18, pp. 1423-1430 (1994).
Chen, "Modulation of CD1d-restricted NKT cell responses by CD4," Journal of Leukocyte Biology, vol. 82, pp. 1455-1465 (2007).
Denkberg, "Recombinant human single-chain MHC-peptide complexes made from *E. coli* by in vitro refolding: functional single-chain MHC-peptide complexes and tetramers with tumor associated antigens," Eur. J. Immunol., vol. 30, pp. 3522-3532 (2000).
Dibrino, "Endogenous peptides bound to HLA-A3 possess a specific combination of anchor residues that permit identification of potential antigenic peptides," Proc. Natl. Acad. Sci. USA, vol. 90, pp. 1508-1512 (1993).
Drake, "Cutting Edge: Lipid Raft Integrity Affects the Efficiency of MHC Class I Tetramer Binding and Cell Surface TCR Arrangement on CD8+ T Cells," The Journal of Immunology, vol. 166, No. 12, pp. 7009-7013 (2001).
He, "Procedure for preparing peptide-major histocompatibility complex tetramers for direct quantification of antigen-specific cytotoxic T lymphocytes," World J Gastroenterol, vol. 11, No. 27, pp. 4180-4187 (2005).
IEBD Analysis Resource, at; tools.immuneepitiope.org/tools/population/tutorial.jsp (3 pages), Jul. 26, 2012.
Kao, "Loss of CD8 and TCR binding to Class I MHC ligands following T cell activation," International Immunology, vol. 17, No. 12, pp. 1607-1617 (2005).
Karin, "Reversal of Experimental Autoimmune Encephalomyelitis by a Soluble Peptide Variant of a Myelin Basic Protein Epitope: T Cell Receptor Antagonism and Reduction of Interferon γ and Tumor Necrosis Factor α Production," J. Exp. Med., vol. 180, pp. 2227-2237 (1994).
Kronenberg, "The Unconventional Lifestyle of NKT Cells," Nature Reviews Immunology, vol. 2, pp. 557-568 (2002).
Parker, "Peptide Binding to HLA-A2 and HLA-B27 Isolated from *Escherichia coli*," The Journal of Biological Chemistry, vol. 267, pp. 5451-5459 (1992).
Rognan, "Rational design of nonnatural peptides as high-affinity ligands for the HLA-B*2705 human leukocyte antigen," Proc. Natl. Acad. Sci. USA, vol. 92, pp. 753-757 (1995).
Ruan, "Preparation of HLA-A*0201 NLVPMVATV peptide tetramers and application to detect cytomegalovirus specific CTL," Zhonghua Weishengwuxue He Mianyixue Zazhi, vol. 26., No. 9, pp. 855-858 (2006)—English Abstract Only.
Ruan, "Improved preparation of class I HLA tetramers and their use in detecting CMV-specific CTL," Journal of Immunological Methods, vol. 312, pp. 148-156 (2006).
Schueler-Furman, "Structure-based prediction of binding peptides to MHC class I molecules: Application to a broad range of MHC alleles," Protein Science, vol. 9, pp. 1838-1846 (2000).
Weinberg, "The Biology of Cancer," Garland Science, pp. 737-747 (2007).

(56) References Cited

OTHER PUBLICATIONS

Wulff, "Guide to Flow Cytometry," Dako Educational Guide, www.dako.com, (2006).
U.S. Appl. No. 08/374,468, filed Jan. 18, 1995, Boehringer Mannheim.
Altman et al., "Formation of functional peptide complexes of class II major histocompatibility complex proteins from subunits produced in *Escherichia coli*," Proc. Natl. Acad. Sci. USA, pp. 10330-10334, Nov. 1993, vol. 90.
Altman et al., "Phenotypic Analysis of Antigen-Specific T Lymphocytes," Science 274:94-97, 1996.
Appel et al., "Anergy induction by dimeric TCR ligands," J. Immunol., pp. 5279-5285, Apr. 15, 2001, vol. 166.
Appel et al., "Kinetics of T-cell receptor binding by bivalent HLA-DR-peptide complexes that activate antigen-specific human T-cells," J. Biol. Chem., pp. 312-321, Jan. 7, 2000, vol. 275.
Andersen et al., "Spontaneous cytotoxic T-cell responses against survivin MHC class I-restricted T-cell epttopes in situ as well as ex vivo in cancer patients," Cancer Res., vol. 61, pp. 5964-5968, Aug. 15, 2001.
Ausubel et al., "Characterization of in vivo expanded OspA-specific human T-cell clones," Clinical Immunology, Academic Press, pp. 313-322, Jun. 1, 2005 (Jun. 1, 2005), vol. 115, No. 3.
Bakker et al., "MHC multimer technology: Current status and future prospects," Current Opinion in Immunology, 17:428-433, 2005.
Barany et al., "Solid-phase peptide synthesis: A silver anniversary report," Int. J. Peptide Protein Res., 30:705-739, 1987 (Abstract Only).
Batard et al., "Dextramers: New generation of fluorescent MHC class I-peptide multimers for visualization of antigen-specific CD8<+> T cells," Journal of Immunological Methods, Elsevier Science Publishers, pp. 136-148, Mar. 20, 2006 (Mar. 20, 2006), vol. 310, No. 1-2.
Berger et al., "Circulation and hoimg of melanoma-reactive T cells to both cutaneous and visceral metastases after vaccination with monocyte-derived dendritic cells," Int. J. Cancer, pp. 229-237, 2004, vol. 111.
Bergmeier et al., "Innate and adoptive mucosal immunity in protection against HIV infection," Advances in Dental Research 2006, pp. 21-28, 2006, vol. 19, No. 1, XP002562924.
Bill et al., "Use of soluble MHC class II-peptide multimers to detect antigen-specific T cells in human disease," Arthritis Res., pp. 261-265, Feb. 28, 2002, vol. 4.
Bjorkman et al., "The foreign antigen binding site and T cell recognition regions of class I histocompatibility antigen," Nature 329:512-518, 1987.
Bogers, "CCR5 targeted SIV vaccination strategy preventing or inhabiting SIV infection," Vaccine, Butterworth Scientific, pp. 2974-2984, Aug. 13, 2004 (Aug. 13, 2004), vol. 22, No. 23-24. Guildford, GB.
Burlingham et al., "Soluble MHC, Immunoregulation, and tolerance: A progress report," Human Immunol., pp. 1316-1319, Dec. 2000, vol. 61.
Callan et al., "Direct Visualizing of Antigen.specific CD8+ T Cells during th ePRimary Immune Response to Epstein-Barr Virus in Vivo," J. Exp. Med., May 1998, pp. 1395-1402, vol. 187, No. 9.
Cameron et al., "Labeling antigen-specific DC4(+) T cells with class II MHC oligomers," J. Immunol. Methods, pp. 51-69, Oct. 1, 2002, vol. 268.
Carena et al., "Major Histocompatibility Complex Class I Molecules Modulate Activation Threshold and Early Signaling of T-Cell Antigen Receptor-γδ Stimulated by Nonpeptidic Ligands," J. Exp. Med., Nov. 17, 1997, pp. 1769-1774, 186 (10).
Casares et al., "Antigen-specific downregulation of T cells by doxorubicin delivered through a recombinant MHC II-peptide chimera," Nature Biotech., pp. 142-147, Feb. 2001, vol. 19.
Cochran et al., "Receptor clustering and transmembrane signaling T cells," TIBS, pp. 304-310, May 2001, vol. 26 (Abstract Only).
Coles et al., "Memory CD8 T lymphocytes express inhibitory MHC-specific Ly49 receptors," Eur. J. Immunol. 30:236-244, 2000.

Constantin et al., "Major histocompatibility complex (MHC) tetramer technologt: An evaluation," Biol. Res. Nursing, pp. 115-127, Oct. 2002, vol. 4.
Dal Porto et al, "A soluble divalent class I major histocompatibility complex molecule inhibits alloreactive T cells at nanomolar concentrations," Porc. Natl. Acad. Sci. 90.6671-6675, 1993.
Dako: "MHC Dextramers" Internet Article Jul. 6, 2006 URL: pri.dako.com-00207_mhcdex_0406.pdf.
Devito-Haynes et al., "Soluble donor HLA class I and β2-m-free heavy chain in serum of lung transplant recipients: Steady-state levels and increases in patients with recurrent CMV infection, acute rejection episodes, and poor outcome," Human Immunol., pp. 1370-1382, Dec. 2000, vol. 61.
Drouin et al., "Searching for borrelial T-cell epitopes associated with antibiotic-refractory Lyme arthritis," Molecular Immunology, pp. 2323-2332, Jan. 11, 2008 (Jan. 11, 2008), vol. 45, No. 8, GB.
Ed. Charron, "HLA: Genetic diversity of HLA. Functional and Medical Implication," EDK Press, pages corresponding to Tables 1A and 1B, 1997.
Erout et al., "Preparation of Conjugates between Oligonucleotide and N-Vinylpyrrolidone-N-Acryoxysuccinimide Copolymers and Applications in Nucleic Acid Assays to Improve Sensitivity," Bioconjugate Chem. 1996, pp. 568-575, vol. 7.
Fields et al., "Solid phase peptide synthesis utilizing 9-fluorenylmethoxycarbonyl amino acids," Int. J. Peptide Res., 353:161-214, 1990 (Abstract Only).
Frayser et al., "Empty and peptide-loaded class II major histocompatibility complex proteins produced by expression in *Escherichia coli* and folding in vitro," Protein Expression and Purification, pp. 105-114, Feb. 1999, vol. 15 (Abstract Only).
Garboczi et al., "HLA-A2.peptide complexes: Refolding and crystallization of molecules expressed in *Escherichia coli* and complexed with single antigenic peptides," Proc. Natl. Acad. Sci., 89:3429-3433, 1992.
Gordon et al., "Applications of Combinatorial Technologies to Drug Discovery. 2. Combinatorial Organic Synthesis, Library Screening Strategies, and Future Directions," Journal of Medicinal Chemistry, 37 (10):1385-1401, 1994 (Abstract Only).
Haanen et al., "In situ detection of virus- and tumor-specific T-cell Immunity," Nature Medicine, Sep. 2000, pp. 1056-1060, vol. 6 (Abstract Only).
Hadrup et al., "Persistence of survivin specific T cells for seven years in a melanoma patient during complete remission," Cancer Biol. Ther., pp. 480-482, May 2006, vol. 5.
Houghten et al., "Generation and use of synthetic peptide combinatorial libraries for basic research and drug discovery," Nature, 354:84-86, 1991 (Abstract Only).
Huges et al., "Generation and use of alternative multimers of peptide-MHC complexes," Journal of Immunological Methods, 268:83-92, 2002.
Jung et al., "Multiple Peptide Synthesis Methods and their Applications," Angewandte Chemie, 31 (4):367-486, 1992 (Abstract Only).
Kalandadze et al., "Expression of Recombinant HLA-DR2 molecules," J. Biol. Chem., pp. 20156-20162, Aug. 16, 1996, vol. 271.
Knabel et al., "Reversible MHC multimer staining for functional isolation of T-cell populations and effective adoptive transfer," Nature Medicine, Nature Publishing Group, pp. 631-637, Jun. 1, 2002 (Jun. 1, 2002), vol. 8, No. 6.
König, "Interactions between MHC molecules and co-receptors of the TCR," Current Opinion in Immunology, pp. 75-83, 2002, vol. 14.
Kozono et al., "Production of soluble MHC class II proteins with covalently bound single peptides," Nature, pp. 151-154, May 12, 1994, vol. 369 (Abstract Only).
Kuroda et al., "Analysis of Gag-specific Cytotoxic T Lymphocytes in Simian Immunodeficiency Virus-intected Rhesus Monkeys by Cell Staining with Tetrameric Major Histocompatibility Complex Class I-Peptide Complex," J.Exp. Med., May 4, 1998, 1373-1381, vol. 187, No. 9.
Kuttler et al., "An Algorithm for the Prediction of Proteasomal Cleavages," J. Miol. Biol., 298:417-429, 2000.

(56) References Cited

OTHER PUBLICATIONS

Larsson, "Immunocytochemical detection systems," in Immunocytohemistry: Theory and Practice, pp. 77-145, CRC Press, 1988.

Lee et al., "Characterizatio of circulating T cells specific for tumor-associateda ntigens in melanoma patients," Nature Medicine, Jun. 1999, pp. 677-685, vol. 5, No. 6.

Lehner, "Allomicrovac: A combined microbicidal-immunising strategy against SIV and HIV infection," Vaccines for Humans, pp. 64-65, Dec. 5, 2008 (Dec. 5, 2008), XP0025629223, URL: http://www.biblioteca.porto.ucp.pt-docbweb-MULTIMEDIA-ASSOCIA-PDF-VAC.PDF.

Ljunggren et al., "Empty MHC class I molecules come out in the cold," Nature 346:476-480, 1990.

Mallone et al., "MHC class II tetramers and the pursuit of antigen-specific T cells: Define, deviate, delete," Clin. Immunol., pp. 232-242, 2004, vol. 110.

Marchand et al., "Tumor regression responses in melanoma patients treated with a peptide encoded by gene MAGE-3,"Int. J. Cancer, 63:883-885, 1995.

Matsumura et al., "Emerging Principles for the Recognition of Peptide Antigen by MHC class I Molecules," Science 257:927-934, 1992.

Matsumura et al., "In vitro peptide binding to soluble empty calss I major histocompatibility complex molecules isolated from transfected Drosophila melanogaster cells," J. Biol. Chem., pp. 23589-23595, Nov. 25, 1992, vol. 267.

McCluskey et al., "T-cell activation by purified, soluble , class I MHC molecules: Requirement for polyvalency," J. Immunol. 141(5): 1451-55, 1988.

McHeyzer-Williams et al., "Tracking antigen-specific helper T cell responses," Current Opinion in Immunology, pp. 278-284, 1996, vol. 8.

Merrifield et al., "Instrument for Automated Synthesis of peptides," Analytical Chemistry, 38 (13):1905-1914, 1966 (Abstract Only).

Merrifield, "Solid Phase Synthesis," Science 232:341-347, 1986 (Abstract Only).

Meyer et al., "Direct enumeration of Borrelia-reactive CD4 T-cell ex vivo by using MHC class II tetramers," Proceedings of the National Academy of Sciences of USA. (PNAS), National Academy of Science, pp. 11433-11438, Oct. 10, 2000 (Oct. 10, 2000), vol. 97, No. 21, Washington D.C., US.

Mutis et al., "Tetrameric HLA class I-minor histocompatability antigen peptide complexes demnstrate minor histocompatibility antigen-specific cytoxic T lymphocytes in patients with graft-visus-host disease," Nature Medicine, Jul. 1999, pp. 839-842, vol. 5, No. 7.

Neudorfer et al., "Reversible HLA multimers (streptamers) for the isolation of human cytotoxic T lymphocytes functionally active against tumor- and virus-derived antigens," Journal of Immunological Methods, 320:119-131, 2007.

O'Herrin et al., "Analysis of the Expression of Peptide-Major Histocaompatibility Complexes using high affinity Soluble Divalent T-Cell Receptors," The Journal of Biological Chemistry, Oct. 20, 1997, pp. 1333-1345, vol. 186, No. 8.

Reich et al., "Stability of empty and peptide-loaded class II major histocompatibility complex molecules at neutral and endosomal pH: Comparison to class I proteins," Proc. Natl. Acad. Sci. USA, pp. 2495-2500, Mar. 1997, vol. 94.

Reijonen et al., "Use of HLA class II tetramers in tracking antigen-specific T cell and mapping T-call epitopes," pp. 282-288, 2003, vol. 29.

Scheirle et al., "Peptide binding to soluble HLA-DR4 molecules produced by insect cells," J. Immunol., pp. 1994-1999, Sep. 15, 1992, vol. 149 (Abstract Only).

Scheffold et al., "Recent Development in Flow Cytometry," Journal of Clinical Immunology, Aug. 2000, vol. 20, No. 6.

Sengupta et al., "Heat shock protein-mediated cross-presentation of exogenous HIV antigen on HLA class I and class II," Journal of Immunology, American Association of Immunologists, pp. 1987-1993, Aug. 1, 2004 (Aug. 1, 2004), vol. 173, No. 3.

Shambrook, Fritsch and Maniatis, "Molecular Cloning," Cold Spring Harbor Press, 1989, Index and Table of Contents pp. xi to xxxviii and 1-1 to 1-47.

Shields et al., "The Effect of Human β2—Microglobulin on Major Histocompatibility Complex I Peptide Loading and the Engineering of a High Affinity Variant," The Journal of Biological Chemistry, Oct. 23, 1998, pp. 28010-28018, vol. 273, No. 43.

Siiman et al., Bioconjugate Chem. 1999, pp. 1090-1106.

Skinner et al., "In situ tetramer staining," J. Immunol. Meth., pp. 29-34, 2002, vol. 268.

Sørensen et al., "Efficient tumor cell lysis mediated by a bcl-X(L) specific T cell clone isolated from a breast cancer patient," Cancer Immunology, Immunotherapy, Springer, pp. 527-533, Jul. 19, 2006 (Jul. 19, 2006), vol. 56, No. 4.

Stern et al., "The human class II MHC protein HLA-DR1 assembles as empty alpha beta heterodimers in the absence of antigenic peptide," Cell, pp. 465-477, Feb. 7, 1992, vol. 68 (Abstract Only).

Stratmann et al., "Susceptible MHC Alleles, not background genes, select an autoimmune T cell reactivity," The Journal of Clinical Investigation, pp. 902-914, Sep. 2003, vol. 112, No. 6.

Stöckel et al., "Refolding of human class II major histocompatibility complex molecules isolated from *Escherichia coli*", J. Biol. Chem., pp. 29571-29578, Nov. 25, 1994, vol. 269.

Sun et al., "MHC class I multimers," Arthritis Res., pp. 265-269, Jul. 2001, vol. 3.

Ugolini et al., "Regulation of T cell function by NK cell receptors for classical MHC class I molecules," Current Opinion in Immunology 12:295-300, 2000.

Valmori et al., "Enhanced generation of specific tumor-reactive CTL in vitro by selected Melan-A-MART-1 immunodominant peptide analogues," J. Immunol., pp. 1750-1758, Feb. 15, 1998, vol. 160.

Viola et al., "T-cell activation and the dynamic world of rafts.," APMIS 107:615-623, 1999.

Vyth-Dreese et al., "In situ visualization of antigen specific T cells in cryopreserved human tissues," J. Immunol. Meth., pp. 78-85, 2006, vol. 310.

White et al., "Soluble class I MHC with β2-microglobulin covalently linked peptides: Specific binding to a T cell hybridoma," J. Immunol., pp. 2671-2676, Mar. 1, 1999, vol. 162.

Xu et al., "MHC-peptide tetramer-based studies of T cell function," J. Immunol Meth., pp. 21-28, 2002, vol. 268.

Zhang et al., "Essential role of LAT in T cell development," Immunity 10:323-332, 1999.

Scholler et al. "A recombinant human HLA-class I antigen linked to dextran elicits innate and adaptive immune responses," Journal of Immunological Methods, vol. 360, pp. 1-9 (2010).

Morner et al. "Immunization with Recombinant HLA Classes I and II, HIV-1 gp140, and SIV p27 Elicits Protection against Heterologous SHIV Infection in Rhesus Macaques," Journal of Virology, vol. 85, No. 13, pp. 6442-6452 (2011).

Yang et al. "Immunization with recombinant macaque major histocompatibility complex class I and II and human immunodeficiency virus gp140 inhibits simian—human immunodeficiency virus infection in macaques," Journal of General Virology, vol. 93, pp. 1506-1518 (2012).

Wang et al. "The Role of Innate APOBEC3G and Adaptive AID Immune Responses in HLA-HIV/SIV Immunized SHIV Infected Macaques," PLoS ONE, vol. 7, No. 4, pp. 1-13 (2012).

Andersen et al., Parallel detection of antigen-specific T-cell responses by combinatorial encoding of MHC multimers. NatProtoc., vol. 7, No. 5, pp. 891-902 (2012).

HLA nomenclature—HLA allele numbers (hla.alleles.org/nomenclature/stats.html (2010).

Celis et al., Induction of anti-tumor cytotoxic T lymphocytes in normal humans using primary cultures and synthetic peptide epitopes. Proc Natl Arad Sci USA, vol. 91, 2105-2109 (1994).

Cortez-Gonzales et al., Immunogenic HLA-B7-restricted peptides of hTRT. Intl Immunology vol. 18, No. 12 1707-1718 (2006).

Dibrino et al., "HLA-A1 and HLA-A3 T cell epitopes derived from influenza virus proteins predicted from peptide binding motifs." J Immunol., 151(11):5930-5 (1993).

(56) References Cited

OTHER PUBLICATIONS

Larsen MV (4/07 Prediction of T-cell epitopes for therapeutic and prophylactic vaccines, Ph.D. thesis, Center for Biological Sequence Analysis BioCentrum DTU—Denmark), (2007).

Lauritsen et al., Two distinct pathways exist for down-regulation of the TCR. J Immunology, 161:260-7 (1998).

Maher, 'Liposomes and Micelles', Dynamic Chiropractic. www.dynamicchirpractic.com (2016).

Niikolich-Zugich et al. The many important facets of t-cell repertoire diversity. Nature Reviews Immunology, vol. 4, 123-132 (2004).

Ochoa-Garay et al., The ability of peptides to induce cytotoxic T cells in vitro does not strongly correlate with their affinity for the H-2Ld molecule: Implications for vaccine design and immunotherapy. Molecular Immunology vol. 34 No. 3 273-281 (1997).

Oka et al., Induction of WT1 (Wilms' tumor gene)-specific cytotoxic T lymphocytes by WT1 peptide vaccine and the resultant cancer regression. PNAS vol. 101 No. 38 13885-13890 (2004).

Rammensee et al. MHC ligands and peptide motifs: first listing. Immunogenetics 41:178-228 (1995).

H. S. Reker et al., "Parallel detection of antigen-specific T-cell responses by multidimensional encoding of MHC multimers", Nature Methods (Nature Publishing Group), Basinstoke GB, vol. 6, No. 7, doi:10.1038/NMETH.1345, ISSN 1548-7091, pp. 520-528 (2009).

Schroers et al., Identification of HLA DR7-restricted epitopes from human telomerase reverse transcriptase recognized by CD4+ T-helper cells, Cancer Research 62, 2600-2605 (2002).

Speiser et al., In Vivo Activation of Melanoma-Specific CD8(+) T Cells by Endogenous Tumor Antigen and Peptide Vaccines. A Comparison to Virus-Specific T Cells. Eur J Immunol 32:731-741 (2002).

Stoeva et al., "Multiplexed Detection of Protein Cancer Markers with Biobarcoded Nanoparticle Probes", Journal of The American Chemical Society, American Chemical Society, US, vol. 128, No. 26, doi:10.1021/JA0613106, ISSN 0002-7863, (2006), pp. 8378-8379 (2006).

Sano et al., Immuno-PCR: Very sensitive antigen detection by means of specific antibody-DNA conjugates. Science American Association for the Advancement of Science, US, vol. 258, No. 5079, 120-122 (1992).

Theisen et al., "Evolution of the borrelia burgdorferi outer surface protein OspC", J. Bacter. 177, pp. 3036-3044 (1995).

Holst et al., "Rapid and sustained CD4+ T-cell independent immunity from adenovirus-encoded vaccine antigens," J. Gen. Virol., 88: 1708-1716, 2007.

* cited by examiner

Figure 1

HLA-A HLA-B HLA-C HLA-E HLA-F HLA-G

A*01010101 B*070201 Cw*010201 E*01010101 F*01010101 G*01010101

A*01010102N B*070202 Cw*010202 E*01010102 F*01010102 G*01010102

A*010102 B*070203 Cw*010203 E*01010103 F*01010103 G*01010103

A*010103 B*070204 Cw*010204 E*01030101 F*01010104 G*01010104

A*010104 B*0703 Cw*0103 E*01030102 F*01010105 G*01010105

A*0102 B*0704 Cw*0104 E*010302 F*01010106 G*01010201

A*0103 B*070501 Cw*0105 E*010303 F*01010107 G*01010202

A*0104N B*070502 Cw*0106 E*010304 F*01010108 G*010103

A*0106 B*070503 Cw*0107 E*0104 F*01010201 G*010104

A*0107 B*0706 Cw*0108 F*01010202 G*010105

A*0108 B*0707 Cw*0109 F*01010203 G*010106

A*0109 B*0708 Cw*0110 F*01010204 G*010107

A*0110 B*0709 Cw*0111 F*01010205 G*010108

A*0111N B*0710 Cw*0112 F*01010301 G*010109

A*0112 B*0711 Cw*0113 F*01010302 G*010110

A*0113 B*0712 Cw*020201 F*01010303 G*0102

A*0114 B*0713 Cw*020202 F*01010304 G*0103

A*0115N B*0714 Cw*020203 F*0102 G*010401

A*0116N B*0715 Cw*020205 F*01030101 G*010402

A*0117 B*0716 Cw*0203 F*01030102 G*010403

A*0118N B*0717 Cw*0204 F*0104 G*0105N

A*0119 B*0718 Cw*0205 G*0106

A*0120 B*0719 Cw*0206 G*0107

A*02010101 B*0720 Cw*0207

A*02010102L B*0721 Cw*0208

A*020102 B*0722 Cw*0209

A*020103B*0723Cw*0210
A*020104B*0724Cw*0211
A*020105B*0725Cw*0212
A*020106B*0726Cw*0213
A*020107B*0727Cw*0214
A*020108B*0728Cw*0215
A*020109B*0729Cw*0216
A*020110B*0730Cw*0217
A*020111B*0731Cw*030201
A*020112B*0732Cw*030202
A*0202B*0733Cw*030301
A*020301B*0734Cw*030302
A*020302B*0735Cw*030303
A*0204B*0736Cw*030304
A*0205B*0737Cw*030305
A*020601B*0738Cw*030401
A*020602B*0739Cw*030402
A*020603B*0740Cw*030403
A*0207B*0741Cw*030404
A*0208B*0742Cw*030405
A*0209B*0743Cw*0305
A*0210B*0744Cw*0306
A*0211B*0745Cw*0307
A*0212B*0746Cw*0308
A*0213B*0747Cw*0309
A*0214B*0748Cw*0310
A*0215NB*0749NCw*031101
A*0216B*0750Cw*031102
A*021701B*0751Cw*0312

Fig. 1 cont'd

A*021702B*080101Cw*0313
A*0218B*080102Cw*0314
A*0219B*080103Cw*0315
A*022001B*0802Cw*0316
A*022002B*0803Cw*0317
A*0221B*0804Cw*0318
A*0222B*0805Cw*0319
A*0224B*0806Cw*0320N
A*0225B*0807Cw*0321
A*0226B*0808NCw*0322Q
A*0227B*0809Cw*0323
A*0228B*0810Cw*0324
A*0229B*0811Cw*0325
A*0230B*0812Cw*0326
A*0231B*0813Cw*0327
A*0232NB*0814Cw*0328
A*0233B*0815Cw*0329
A*0234B*0816Cw*0330
A*023501B*0817Cw*0331
A*023502B*0818Cw*0332
A*0236B*0819NCw*0333
A*0237B*0820Cw*0334
A*0238B*0821Cw*0335
A*0239B*0822Cw*04010101
A*0240B*0823Cw*04010102
A*0241B*0824Cw*040102
A*0242B*0825Cw*040103
A*0243NB*0826Cw*040104
A*0244B*0827Cw*0403

Fig. 1 cont'd

A*0245B*0828Cw*040401

A*0246B*0829Cw*040402

A*0247B*0830NCw*0405

A*0248B*0831Cw*0406

A*0249B*1301Cw*0407

A*0250B*130201Cw*0408

A*0251B*130202Cw*0409N

A*0252B*130203Cw*0410

A*0253NB*1303Cw*0411

A*0254B*1304Cw*0412

A*0255B*1306Cw*0413

A*0256B*1307NCw*0414

A*0257B*1308Cw*0415

A*0258B*1309Cw*0416

A*0259B*1310Cw*0417

A*0260B*1311Cw*0418

A*0261B*1312Cw*0419

A*0262B*1313Cw*0420

A*0263B*1314Cw*0421

A*0264B*1315Cw*0423

A*0265B*1316Cw*0424

A*0266B*1317Cw*050101

A*0267B*1401Cw*050102

A*0268B*140201Cw*050103

A*0269B*140202Cw*0502

A*0270B*1403Cw*0503

A*0271B*1404Cw*0504

A*0272B*1405Cw*0505

A*0273B*140601Cw*0506

Fig. 1 cont'd

A*027401B*140602Cw*0507N

A*027402B*1407NCw*0508

A*0275B*15010101Cw*0509

A*0276B*15010102NCw*0510

A*0277B*150102Cw*0511

A*0278B*150103Cw*0512

A*0279B*150104Cw*0513

A*0280B*1502Cw*0514

A*0281B*1503Cw*0515

A*0282NB*1504Cw*06020101

A*0283NB*1505Cw*06020102

A*0284B*1506Cw*060202

A*0285B*1507Cw*0603

A*0286B*1508Cw*0604

A*0287B*1509Cw*0605

A*0288NB*1510Cw*0606

A*0289B*151101Cw*0607

A*0290B*151102Cw*0608

A*0291B*151103Cw*0609

A*0292B*1512Cw*0610

A*0293B*1513Cw*0611

A*0294NB*1514Cw*0612

A*0295B*1515Cw*0613

A*0296B*1516Cw*0614

A*0297B*15170101Cw*070101

A*0299B*15170102Cw*070102

A*03010101B*151702Cw*070103

A*03010102NB*1518Cw*070104

A*03010103B*1519Cw*070105

Fig. 1 cont'd

A*030102B*1520Cw*070106

A*030103B*1521Cw*070107

A*030104B*1523Cw*07020101

A*030105B*1524Cw*07020102

A*0302B*1525Cw*07020103

A*0303NB*1526NCw*0703

A*0304B*1527Cw*070401

A*0305B*1528Cw*070402

A*0306B*1529Cw*0705

A*0307B*1530Cw*0706

A*0308B*1531Cw*0707

A*0309B*1532Cw*0708

A*0310B*1533Cw*0709

A*0311NB*1534Cw*0710

A*0312B*1535Cw*0711

A*0313B*1536Cw*0712

A*0314B*1537Cw*0713

A*0315B*1538Cw*0714

A*0316B*1539Cw*0715

A*0317B*1540Cw*0716

A*0318B*1542Cw*0717

A*0319B*1543Cw*0718

A*0320B*1544Cw*0719

A*0321NB*1545Cw*0720

A*0322B*1546Cw*0721

A*0323B*1547Cw*0722

A*0324B*1548Cw*0723

A*0325B*1549Cw*0724

A*0326B*1550Cw*0725

Fig. 1 cont'd

A*110101B*1551Cw*0726

A*110102B*1552Cw*0727

A*110103B*1553Cw*0728

A*110104B*1554Cw*0729

A*110105B*1555Cw*0730

A*110106B*1556Cw*0731

A*110201B*1557Cw*0732N

A*110202B*1558Cw*0733N

A*1103B*1560Cw*0734

A*1104B*1561Cw*0735

A*1105B*1562Cw*0736

A*1106B*1563Cw*0737

A*1107B*1564Cw*0738

A*1108B*1565Cw*0739

A*1109B*1566Cw*0740

A*1110B*1567Cw*0741

A*1111B*1568Cw*0742

A*1112B*1569Cw*0743

A*1113B*1570Cw*0744

A*1114B*1571Cw*0745

A*1115B*1572Cw*080101

A*1116B*1573Cw*080102

A*1117B*1574Cw*0802

A*1118B*1575Cw*0803

A*1119B*1576Cw*0804

A*1120B*1577Cw*0805

A*1121NB*1578Cw*0806

A*1122B*1579NCw*0807

A*1123B*1580Cw*0808

Fig. 1 cont'd

A*1124B*1581Cw*0809

A*1125B*1582Cw*0810

A*1126B*1583Cw*0811

A*1127B*1584Cw*0812

A*1128B*1585Cw*0813

A*1129B*1586Cw*0814

A*2301B*1587Cw*120201

A*2302B*1588Cw*120202

A*2303B*1589Cw*120203

A*2304B*1590Cw*12030101

A*2305B*1591Cw*12030102

A*2306B*1592Cw*120302

A*2307NB*1593Cw*120303

A*2308NB*1594NCw*120304

A*2309B*1595Cw*120401

A*2310B*1596Cw*120402

A*2311NB*1597Cw*1205

A*2312B*1598Cw*1206

A*2313B*1599Cw*1207

A*2314B*9501Cw*1208

A*24020101B*9502Cw*1209

A*24020102LB*9503Cw*1210

A*240202B*9504Cw*1211

A*240203B*9505Cw*1212

A*240204B*9506Cw*1213

A*240205B*9507Cw*1214

A*240206B*9508Cw*1215

A*240207B*9509Cw*1216

A*240208B*9510Cw*1217

Fig. 1 cont'd

A*240209B*9511NCw*1218

A*240210B*9512Cw*1219

A*240211B*9513Cw*140201

A*240212B*9514Cw*140202

A*240213B*9515Cw*140203

A*240301B*9516Cw*140204

A*240302B*9517Cw*1403

A*2404B*9518Cw*1404

A*2405B*9519Cw*1405

A*2406B*9520Cw*1406

A*2407B*9521Cw*1407N

A*2408B*9522Cw*1408

A*2409NB*180101Cw*150201

A*2410B*180102Cw*150202

A*2411NB*180103Cw*150203

A*2413B*1802Cw*1503

A*2414B*1803Cw*1504

A*2415B*1804Cw*150501

A*2417B*1805Cw*150502

A*2418B*1806Cw*150503

A*2419B*1807Cw*150504

A*2420B*1808Cw*1506

A*2421B*1809Cw*1507

A*2422B*1810Cw*1508

A*2423B*1811Cw*1509

A*2424B*1812Cw*1510

A*2425B*1813Cw*1511

A*2426B*1814Cw*1512

A*2427B*1815Cw*1513

Fig. 1 cont'd

A*2428B*1817NCw*1514

A*2429B*1818Cw*1515

A*2430B*1819Cw*1516

A*2431B*1820Cw*1517

A*2432B*1821Cw*160101

A*2433B*1822Cw*160102

A*2434B*1823NCw*1602

HLA-H HLA-J HLA-K HLA-L HLA-P

| HLA-DRA | HLA-DRB1 | HLA-DRB3/4/5 | HLA-DQA1 | HLA-DQB1 | HLA-DPA1 | HLA-DPB1 |
|---|---|---|---|---|---|---|
| DRA*0101 | DRB1*010101 | DRB2*0101 | DQA1*010101 | DQB1*050101 | DPA1*010301 | DPB1*010101 |
| DRA*010201 | DRB1*010102 | DRB3*01010201 | DQA1*010102 | DQB1*050102 | DPA1*010302 | DPB1*010102 |
| DRA*010202 | DRB1*010103 | DRB3*01010202 | DQA1*010201 | DQB1*050201 | DPA1*010303 | DPB1*010103 |
|  | DRB1*010104 | DRB3*010103 | DQA1*010202 | DQB1*050202 | DPA1*010304 | DPB1*0102 |
|  | DRB1*010105 | DRB3*010104 | DQA1*010203 | DQB1*050301 | DPA1*0104 | DPB1*020102 |
|  | DRB1*010106 | DRB3*010105 | DQA1*010204 | DQB1*050302 | DPA1*0105 | DPB1*020103 |
|  | DRB1*010107 | DRB3*0102 | DQA1*0103 | DQB1*0504 | DPA1*010601 | DPB1*020104 |
|  | DRB1*010108 | DRB3*0103 | DQA1*010401 | DQB1*0505 | DPA1*010602 | DPB1*020105 |
|  | DRB1*010109 | DRB3*0104 | DQA1*010402 | DQB1*020101 | DPA1*0107 | DPB1*020106 |
|  | DRB1*010110 | DRB3*0105 | DQA1*0105 | DQB1*020102 | DPA1*0108 | DPB1*020107 |
|  | DRB1*010201 | DRB3*0106 | DQA1*0106 | DQB1*0202 | DPA1*0109 | DPB1*0202 |
|  | DRB1*010202 | DRB3*0107 | DQA1*0107 | DQB1*0203 | DPA1*0110 | DPB1*0203 |
|  | DRB1*010203 | DRB3*0108 | DQA1*0201 | DQB1*0204 | DPA1*020101 | DPB1*030101 |
|  | DRB1*010204 | DRB3*0109 | DQA1*030101 | DQB1*0205 | DPA1*020102 | DPB1*030102 |
|  | DRB1*010205 | DRB3*0110 | DQA1*0302 | DQB1*030101 | DPA1*020103 | DPB1*0302 |
|  | DRB1*0103 | DRB3*0111 | DQA1*0303 | DQB1*030102 | DPA1*020104 | DPB1*040101 |
|  | DRB1*0104 | DRB3*0112 | DQA1*040101 | DQB1*030103 | DPA1*020105 | DPB1*040102 |
|  | DRB1*0105 | DRB3*0113 | DQA1*040102 | DQB1*030104 | DPA1*020106 | DPB1*0402 |
|  | DRB1*0106 | DRB3*0201 | DQA1*0402 | DQB1*030201 | DPA1*020201 | DPB1*0403 |
|  | DRB1*0107 | DRB3*020201 | DQA1*0403N | DQB1*030202 | DPA1*020202 | DPB1*050101 |
|  | DRB1*0108 | DRB3*020202 | DQA1*0404 | DQB1*030203 | DPA1*020203 | DPB1*050102 |
|  | DRB1*0109 | DRB3*020203 | DQA1*050101 | DQB1*030204 | DPA1*0203 | DPB1*0502 |
|  | DRB1*0110 | DRB3*020204 | DQA1*050102 | DQB1*030302 | DPA1*0204 | DPB1*0601 |
|  | DRB1*0111 | DRB3*020205 | DQA1*0502 | DQB1*030303 | DPA1*0301 | DPB1*0602 |
|  | DRB1*0112 | DRB3*0203 | DQA1*0503 | DQB1*0304 | DPA1*0302 | DPB1*0801 |
|  | DRB1*0113 | DRB3*0204 | DQA1*0504 | DQB1*030501 | DPA1*0303 | DPB1*0802 |
|  | DRB1*0114 | DRB3*0205 | DQA1*0505 | DQB1*030502 | DPA1*0401 | DPB1*0901 |
|  | DRB1*0115 | DRB3*0206 | DQA1*0506 | DQB1*030503 |  | DPB1*0902 |

| | | | | | |
|---|---|---|---|---|---|
| DRB1*0116 | DRB3*0207 | DQA1*0507 | DQB1*030504 | | DPB1*1001 |
| DRB1*0117 | DRB3*0208 | DQA1*0508 | DQB1*0306 | | DPB1*1002 |
| DRB1*0118 | DRB3*0209 | DQA1*0509 | DQB1*0307 | | DPB1*110101 |
| DRB1*0119 | DRB3*0210 | DQA1*060101 | DQB1*0308 | | DPB1*110102 |
| DRB1*0120 | DRB3*0211 | DQA1*060102 | DQB1*0309 | | DPB1*1102 |
| DRB1*0121 | DRB3*0212 | DQA1*0602 | DQB1*0310 | | DPB1*1301 |
| DRB1*0122 | DRB3*0213 | | DQB1*0311 | | DPB1*1302 |
| DRB1*03010101 | DRB3*0214 | | DQB1*0312 | | DPB1*1401 |
| DRB1*03010102 | DRB3*0215 | | DQB1*0313 | | DPB1*1402 |
| DRB1*030102 | DRB3*0216 | | DQB1*0314 | | DPB1*1501 |
| DRB1*030103 | DRB3*0217 | | DQB1*0315 | | DPB1*1502 |
| DRB1*030104 | DRB3*0218 | | DQB1*0316 | | DPB1*1601 |
| DRB1*030105 | DRB3*0219 | | DQB1*0317 | | DPB1*1602 |
| DRB1*030106 | DRB3*0220 | | DQB1*0318 | | DPB1*1701 |
| DRB1*030107 | DRB3*0221 | | DQB1*0319 | | DPB1*1702 |
| DRB1*030201 | DRB3*0222 | | DQB1*0320 | | DPB1*1801 |
| DRB1*030202 | DRB3*0223 | | DQB1*0321 | | DPB1*1802 |
| DRB1*0303 | DRB3*0224 | | DQB1*0322 | | DPB1*1901 |
| DRB1*0304 | DRB3*030101 | | DQB1*0323 | | DPB1*1902 |
| DRB1*030501 | DRB3*030102 | | DQB1*0324 | | DPB1*200101 |
| DRB1*030502 | DRB3*030103 | | DQB1*0325 | | DPB1*200102 |
| DRB1*030503 | DRB3*0302 | | DQB1*040101 | | DPB1*2002 |
| DRB1*0306 | DRB3*0303 | | DQB1*040102 | | DPB1*2101 |
| DRB1*0307 | DRB4*01010101 | | DQB1*0402 | | DPB1*2102 |
| DRB1*0308 | DRB4*0102 | | DQB1*0403 | | DPB1*2201 |
| DRB1*0309 | DRB4*01030101 | | DQB1*060101 | | DPB1*2202 |
| DRB1*0310 | DRB4*01030102N | | DQB1*060102 | | DPB1*2301 |
| DRB1*0311 | DRB4*010302 | | DQB1*060103 | | DPB1*2302N |
| DRB1*0312 | DRB4*010303 | | DQB1*060104 | | DPB1*2401 |
| DRB1*031301 | DRB4*010304 | | DQB1*060201 | | DPB1*2402 |
| DRB1*031302 | DRB4*0104 | | DQB1*060202 | | DPB1*2501 |
| DRB1*0314 | DRB4*0105 | | DQB1*060301 | | DPB1*2502 |

Fig. 2 cont'd

|   | DRB1*0315 | DRB4*0106 |   | DQB1*060302 | DPB1*260101 |
|---|---|---|---|---|---|
|   | DRB1*0316 | DRB4*0107 |   | DQB1*060401 | DPB1*260102 |
|   | DRB1*0317 | DRB4*0201N |   | DQB1*060402 | DPB1*2602 |
|   | DRB1*0318 | DRB4*0301N |   | DQB1*060403 | DPB1*2701 |
|   | DRB1*0319 | DRB5*010101 |   | DQB1*060501 | DPB1*2801 |
|   | DRB1*0320 | DRB5*010102 |   | DQB1*060502 | DPB1*2901 |
|   | DRB1*0321 | DRB5*0102 |   | DQB1*0606 | DPB1*3001 |
|   | DRB1*0322 | DRB5*0103 |   | DQB1*0607 | DPB1*3101 |
|   | DRB1*0323 | DRB5*0104 |   | DQB1*060801 | DPB1*3201 |
|   | DRB1*0324 | DRB5*0105 |   | DQB1*060802 | DPB1*3301 |
|   | DRB1*0325 | DRB5*0106 |   | DQB1*0609 | DPB1*3401 |
|   | DRB1*0326 | DRB5*0107 |   | DQB1*0610 | DPB1*3501 |
|   | DRB1*0327 | DRB5*0108N |   | DQB1*061101 | DPB1*3601 |
|   | DRB1*0328 | DRB5*0109 |   | DQB1*061102 | DPB1*3701 |
|   | DRB1*0329 | DRB5*0110N |   | DQB1*0612 | DPB1*3801 |
|   | DRB1*0330 | DRB5*0111 |   | DQB1*0613 | DPB1*3901 |
|   | DRB1*0331 | DRB5*0112 |   | DQB1*061401 | DPB1*4001 |
|   | DRB1*0332 | DRB5*0113 |   | DQB1*061402 | DPB1*410101 |
|   | DRB1*0333 | DRB5*0202 |   | DQB1*0615 | DPB1*410102 |
|   | DRB1*0334 | DRB5*0203 |   | DQB1*0616 | DPB1*4401 |
|   | DRB1*0335 | DRB5*0204 |   | DQB1*0617 | DPB1*4501 |
|   | DRB1*0336 | DRB5*0205 |   | DQB1*0618 | DPB1*4601 |
|   | DRB1*0337 | DRB6*0101 |   | DQB1*0619 | DPB1*4701 |
|   | DRB1*0338 | DRB6*0201 |   | DQB1*0620 | DPB1*4801 |
|   | DRB1*0339 | DRB6*0202 |   | DQB1*0621 | DPB1*4901 |
|   | DRB1*0340 | DRB7*010101 |   | DQB1*0622 | DPB1*5001 |
|   | DRB1*0341 | DRB7*010102 |   | DQB1*0623 | DPB1*5101 |
|   | DRB1*0342 | DRB8*0101 |   | DQB1*0624 | DPB1*5201 |
|   | DRB1*0343 | DRB9*0101 |   | DQB1*0625 | DPB1*5301 |
|   | DRB1*0344 |   |   | DQB1*0626N | DPB1*5401 |
|   | DRB1*0345 |   |   | DQB1*0627 | DPB1*5501 |
|   | DRB1*0346 |   |   | DQB1*0628 | DPB1*5601 |

Fig. 2 cont'd

| | | | | | |
|---|---|---|---|---|---|
| | DRB1*0347 | | | DQB1*0629 | | DPB1*5701 |
| | DRB1*0348 | | | DQB1*0630 | | DPB1*5801 |
| | DRB1*040101 | | | DQB1*0631 | | DPB1*5901 |
| | DRB1*040102 | | | DQB1*0632 | | DPB1*6001 |
| | DRB1*040103 | | | DQB1*0633 | | DPB1*6101N |
| | DRB1*0402 | | | DQB1*0634 | | DPB1*6201 |
| | DRB1*040301 | | | DQB1*0635 | | DPB1*6301 |
| | DRB1*040302 | | | | | DPB1*6401N |
| | DRB1*040303 | | | | | DPB1*6501 |
| | DRB1*040304 | | | | | DPB1*6601 |
| | DRB1*0404 | | | | | DPB1*6701 |
| | DRB1*040501 | | | | | DPB1*6801 |
| | DRB1*040502 | | | | | DPB1*6901 |
| | DRB1*040503 | | | | | DPB1*7001 |
| | DRB1*040504 | | | | | DPB1*7101 |
| | DRB1*040505 | | | | | DPB1*7201 |
| | DRB1*040506 | | | | | DPB1*7301 |
| | DRB1*040601 | | | | | DPB1*7401 |
| | DRB1*040602 | | | | | DPB1*7501 |
| | DRB1*040701 | | | | | DPB1*7601 |
| | DRB1*040702 | | | | | DPB1*7701 |
| | DRB1*040703 | | | | | DPB1*7801 |
| | DRB1*0408 | | | | | DPB1*7901 |
| | DRB1*0409 | | | | | DPB1*8001 |
| | DRB1*0410 | | | | | DPB1*8101 |
| | DRB1*0411 | | | | | DPB1*8201 |
| | DRB1*0412 | | | | | DPB1*8301 |
| | DRB1*0413 | | | | | DPB1*8401 |
| | DRB1*0414 | | | | | DPB1*8501 |
| | DRB1*0415 | | | | | DPB1*8601 |
| | DRB1*0416 | | | | | DPB1*8701 |
| | DRB1*0417 | | | | | DPB1*8801 |

Fig. 2 cont'd

|  | | | | | |
|---|---|---|---|---|---|
| DRB1*0418 | | | | | DPB1*8901 |
| DRB1*0419 | | | | | DPB1*9001 |
| DRB1*0420 | | | | | DPB1*9101 |
| DRB1*0421 | | | | | DPB1*9201 |
| DRB1*0422 | | | | | DPB1*9301 |
| DRB1*0423 | | | | | DPB1*9401 |
| DRB1*0424 | | | | | DPB1*9501 |
| DRB1*0425 | | | | | DPB1*9601 |
| DRB1*0426 | | | | | DPB1*9701 |
| DRB1*0427 | | | | | DPB1*9801 |
| DRB1*0428 | | | | | DPB1*9901 |
| DRB1*0429 | | | | | |
| DRB1*0430 | | | | | |
| DRB1*0431 | | | | | |
| DRB1*0432 | | | | | |
| DRB1*0433 | | | | | |
| DRB1*0434 | | | | | |
| DRB1*0435 | | | | | |
| DRB1*0436 | | | | | |
| DRB1*0437 | | | | | |
| DRB1*0438 | | | | | |
| DRB1*0439 | | | | | |
| DRB1*0440 | | | | | |
| DRB1*0441 | | | | | |
| DRB1*0442 | | | | | |
| DRB1*0443 | | | | | |
| DRB1*0444 | | | | | |
| DRB1*0445 | | | | | |
| DRB1*0446 | | | | | |
| DRB1*0447 | | | | | |
| DRB1*0448 | | | | | |
| DRB1*0449 | | | | | |

Fig. 2 cont'd

| | | | | |
|---|---|---|---|---|
| DRB1*0450 | | | | |
| DRB1*0451 | | | | |
| DRB1*0452 | | | | |
| DRB1*0453 | | | | |
| DRB1*0454 | | | | |
| DRB1*0455 | | | | |
| DRB1*0456 | | | | |
| DRB1*0457 | | | | |
| DRB1*0458 | | | | |
| DRB1*0459 | | | | |
| DRB1*0460 | | | | |
| DRB1*0461 | | | | |
| DRB1*0462 | | | | |
| DRB1*0463 | | | | |
| DRB1*0464 | | | | |
| DRB1*0465 | | | | |
| DRB1*0466 | | | | |
| DRB1*0467 | | | | |
| DRB1*0468 | | | | |
| DRB1*0469 | | | | |
| DRB1*0470 | | | | |
| DRB1*0471 | | | | |
| DRB1*0472 | | | | |
| DRB1*0473 | | | | |
| DRB1*0474 | | | | |
| DRB1*0475 | | | | |
| DRB1*0476 | | | | |
| DRB1*0477 | | | | |
| DRB1*0478 | | | | |
| DRB1*07010101 | | | | |
| DRB1*07010102 | | | | |
| DRB1*070102 | | | | |

Fig. 2 cont'd

|   | | | | | |
|---|---|---|---|---|---|
| | DRB1*070103 | | | | |
| | DRB1*0703 | | | | |
| | DRB1*0704 | | | | |
| | DRB1*0705 | | | | |
| | DRB1*0706 | | | | |
| | DRB1*0707 | | | | |
| | DRB1*0708 | | | | |
| | DRB1*0709 | | | | |
| | DRB1*0710N | | | | |
| | DRB1*0711 | | | | |
| | DRB1*0712 | | | | |
| | DRB1*0713 | | | | |
| | DRB1*0714 | | | | |
| | DRB1*0715 | | | | |
| | DRB1*0716 | | | | |
| | DRB1*0717 | | | | |
| | DRB1*080101 | | | | |
| | DRB1*080102 | | | | |
| | DRB1*080103 | | | | |
| | DRB1*080104 | | | | |
| | DRB1*080201 | | | | |
| | DRB1*080202 | | | | |
| | DRB1*080203 | | | | |
| | DRB1*080302 | | | | |
| | DRB1*080401 | | | | |
| | DRB1*080402 | | | | |
| | DRB1*080403 | | | | |
| | DRB1*080404 | | | | |
| | DRB1*0805 | | | | |
| | DRB1*0806 | | | | |
| | DRB1*0807 | | | | |
| | DRB1*0808 | | | | |

Fig. 2 cont'd

| | | | | | |
|---|---|---|---|---|---|
| DRB1*0809 | | | | | |
| DRB1*0810 | | | | | |
| DRB1*0811 | | | | | |
| DRB1*0812 | | | | | |
| DRB1*0813 | | | | | |
| DRB1*0814 | | | | | |
| DRB1*0815 | | | | | |
| DRB1*0816 | | | | | |
| DRB1*0817 | | | | | |
| DRB1*0818 | | | | | |
| DRB1*0819 | | | | | |
| DRB1*0820 | | | | | |
| DRB1*0821 | | | | | |
| DRB1*0822 | | | | | |
| DRB1*0823 | | | | | |
| DRB1*0824 | | | | | |
| DRB1*0825 | | | | | |
| DRB1*0826 | | | | | |
| DRB1*0827 | | | | | |
| DRB1*0828 | | | | | |
| DRB1*0829 | | | | | |
| DRB1*0830 | | | | | |
| DRB1*0831 | | | | | |
| DRB1*0832 | | | | | |
| DRB1*0833 | | | | | |
| DRB1*0834 | | | | | |
| DRB1*0835 | | | | | |
| DRB1*0836 | | | | | |
| DRB1*090102 | | | | | |
| DRB1*090103 | | | | | |
| DRB1*090104 | | | | | |
| DRB1*090105 | | | | | |

Fig. 2 cont'd

| | | | | | |
|---|---|---|---|---|---|
| DRB1*090201 | | | | | |
| DRB1*090202 | | | | | |
| DRB1*0903 | | | | | |
| DRB1*0904 | | | | | |
| DRB1*0905 | | | | | |
| DRB1*0906 | | | | | |
| DRB1*0907 | | | | | |
| DRB1*0908 | | | | | |
| DRB1*100101 | | | | | |
| DRB1*100102 | | | | | |
| DRB1*100103 | | | | | |
| DRB1*1002 | | | | | |
| DRB1*1003 | | | | | |
| DRB1*110101 | | | | | |
| DRB1*110102 | | | | | |
| DRB1*110103 | | | | | |
| DRB1*110104 | | | | | |
| DRB1*110105 | | | | | |
| DRB1*110106 | | | | | |
| DRB1*110107 | | | | | |
| DRB1*110108 | | | | | |
| DRB1*110109 | | | | | |
| DRB1*110110 | | | | | |
| DRB1*110201 | | | | | |
| DRB1*110202 | | | | | |
| DRB1*1103 | | | | | |
| DRB1*110401 | | | | | |
| DRB1*110402 | | | | | |
| DRB1*110403 | | | | | |
| DRB1*110404 | | | | | |
| DRB1*110405 | | | | | |
| DRB1*1105 | | | | | |

Fig. 2 cont'd

| | | | | | |
|---|---|---|---|---|---|
| DRB1*110601 | | | | | |
| DRB1*110602 | | | | | |
| DRB1*1107 | | | | | |
| DRB1*110801 | | | | | |
| DRB1*110802 | | | | | |
| DRB1*1109 | | | | | |
| DRB1*111001 | | | | | |
| DRB1*111002 | | | | | |
| DRB1*111101 | | | | | |
| DRB1*111102 | | | | | |
| DRB1*111201 | | | | | |
| DRB1*111202 | | | | | |
| DRB1*111301 | | | | | |
| DRB1*111302 | | | | | |
| DRB1*111401 | | | | | |
| DRB1*111402 | | | | | |
| DRB1*1115 | | | | | |
| DRB1*1116 | | | | | |
| DRB1*1117 | | | | | |
| DRB1*1118 | | | | | |
| DRB1*111901 | | | | | |
| DRB1*111902 | | | | | |
| DRB1*1120 | | | | | |
| DRB1*1121 | | | | | |
| DRB1*1122 | | | | | |
| DRB1*1123 | | | | | |
| DRB1*1124 | | | | | |
| DRB1*1125 | | | | | |
| DRB1*1126 | | | | | |
| DRB1*112701 | | | | | |
| DRB1*112702 | | | | | |
| DRB1*112801 | | | | | |

Fig. 2 cont'd

| | | | | | |
|---|---|---|---|---|---|
| DRB1*112802 | | | | | |
| DRB1*1129 | | | | | |
| DRB1*1130 | | | | | |
| DRB1*1131 | | | | | |
| DRB1*1132 | | | | | |
| DRB1*1133 | | | | | |
| DRB1*1134 | | | | | |
| DRB1*1135 | | | | | |
| DRB1*1136 | | | | | |
| DRB1*1137 | | | | | |
| DRB1*1138 | | | | | |
| DRB1*1139 | | | | | |
| DRB1*1140 | | | | | |
| DRB1*1141 | | | | | |
| DRB1*1142 | | | | | |
| DRB1*1143 | | | | | |
| DRB1*1144 | | | | | |
| DRB1*1145 | | | | | |
| DRB1*1146 | | | | | |
| DRB1*1147 | | | | | |
| DRB1*1148 | | | | | |
| DRB1*1149 | | | | | |
| DRB1*1150 | | | | | |
| DRB1*1151 | | | | | |
| DRB1*1152 | | | | | |
| DRB1*1153 | | | | | |
| DRB1*115401 | | | | | |
| DRB1*115402 | | | | | |
| DRB1*1155 | | | | | |
| DRB1*1156 | | | | | |
| DRB1*1157 | | | | | |
| DRB1*1158 | | | | | |

Fig. 2 cont'd

| | | | | | |
|---|---|---|---|---|---|
| DRB1*1159 | | | | | |
| DRB1*1160 | | | | | |
| DRB1*1161 | | | | | |
| DRB1*1162 | | | | | |
| DRB1*1163 | | | | | |
| DRB1*1164 | | | | | |
| DRB1*116501 | | | | | |
| DRB1*116502 | | | | | |
| DRB1*1166 | | | | | |
| DRB1*1167 | | | | | |
| DRB1*1168 | | | | | |
| DRB1*1169 | | | | | |
| DRB1*1170 | | | | | |
| DRB1*1172 | | | | | |
| DRB1*1173 | | | | | |
| DRB1*1174 | | | | | |
| DRB1*1175 | | | | | |
| DRB1*1176 | | | | | |
| DRB1*1177 | | | | | |
| DRB1*1178 | | | | | |
| DRB1*1179 | | | | | |
| DRB1*1180 | | | | | |
| DRB1*1181 | | | | | |
| DRB1*120101 | | | | | |
| DRB1*120102 | | | | | |
| DRB1*120201 | | | | | |
| DRB1*120202 | | | | | |
| DRB1*120203 | | | | | |
| DRB1*120204 | | | | | |
| DRB1*120302 | | | | | |
| DRB1*1204 | | | | | |
| DRB1*1205 | | | | | |

Fig. 2 cont'd

|  |  |  |  |  |  |
|---|---|---|---|---|---|
| DRB1*1206 | | | | | |
| DRB1*1207 | | | | | |
| DRB1*1208 | | | | | |
| DRB1*1209 | | | | | |
| DRB1*1210 | | | | | |
| DRB1*1211 | | | | | |
| DRB1*1212 | | | | | |
| DRB1*1213 | | | | | |
| DRB1*1214 | | | | | |
| DRB1*1215 | | | | | |
| DRB1*1216 | | | | | |
| DRB1*1217 | | | | | |
| DRB1*1218 | | | | | |
| DRB1*1219 | | | | | |
| DRB1*130101 | | | | | |
| DRB1*130102 | | | | | |
| DRB1*130103 | | | | | |
| DRB1*130104 | | | | | |
| DRB1*130105 | | | | | |
| DRB1*130201 | | | | | |
| DRB1*130202 | | | | | |
| DRB1*130203 | | | | | |
| DRB1*130301 | | | | | |
| DRB1*130302 | | | | | |
| DRB1*1304 | | | | | |
| DRB1*130501 | | | | | |
| DRB1*130502 | | | | | |
| DRB1*1306 | | | | | |
| DRB1*130701 | | | | | |
| DRB1*130702 | | | | | |
| DRB1*1308 | | | | | |
| DRB1*1309 | | | | | |

Fig. 2 cont'd

| | | | | | |
|---|---|---|---|---|---|
| DRB1*1310 | | | | | |
| DRB1*131101 | | | | | |
| DRB1*131102 | | | | | |
| DRB1*1312 | | | | | |
| DRB1*1313 | | | | | |
| DRB1*131401 | | | | | |
| DRB1*131402 | | | | | |
| DRB1*131403 | | | | | |
| DRB1*1315 | | | | | |
| DRB1*1316 | | | | | |
| DRB1*1317 | | | | | |
| DRB1*1318 | | | | | |
| DRB1*1319 | | | | | |
| DRB1*1320 | | | | | |
| DRB1*1321 | | | | | |
| DRB1*1322 | | | | | |
| DRB1*1323 | | | | | |
| DRB1*1324 | | | | | |
| DRB1*1325 | | | | | |
| DRB1*1326 | | | | | |
| DRB1*1327 | | | | | |
| DRB1*1328 | | | | | |
| DRB1*1329 | | | | | |
| DRB1*1330 | | | | | |
| DRB1*1331 | | | | | |
| DRB1*1332 | | | | | |
| DRB1*133301 | | | | | |
| DRB1*133302 | | | | | |
| DRB1*133303 | | | | | |
| DRB1*1334 | | | | | |
| DRB1*1335 | | | | | |
| DRB1*1336 | | | | | |

Fig. 2 cont'd

| | | | | | |
|---|---|---|---|---|---|
| DRB1*1337 | | | | | |
| DRB1*1338 | | | | | |
| DRB1*1339 | | | | | |
| DRB1*1340 | | | | | |
| DRB1*1341 | | | | | |
| DRB1*1342 | | | | | |
| DRB1*1343 | | | | | |
| DRB1*1344 | | | | | |
| DRB1*1345 | | | | | |
| DRB1*1346 | | | | | |
| DRB1*1347 | | | | | |
| DRB1*1348 | | | | | |
| DRB1*1349 | | | | | |
| DRB1*135001 | | | | | |
| DRB1*135002 | | | | | |
| DRB1*1351 | | | | | |
| DRB1*1352 | | | | | |
| DRB1*1353 | | | | | |
| DRB1*1354 | | | | | |
| DRB1*1355 | | | | | |
| DRB1*1356 | | | | | |
| DRB1*1357 | | | | | |
| DRB1*1358 | | | | | |
| DRB1*1359 | | | | | |
| DRB1*1360 | | | | | |
| DRB1*1361 | | | | | |
| DRB1*1362 | | | | | |
| DRB1*1363 | | | | | |
| DRB1*1364 | | | | | |
| DRB1*1365 | | | | | |
| DRB1*1366 | | | | | |
| DRB1*1367 | | | | | |

Fig. 2 cont'd

| | | | | | |
|---|---|---|---|---|---|
| DRB1*1368 | | | | | |
| DRB1*1369 | | | | | |
| DRB1*1370 | | | | | |
| DRB1*1371 | | | | | |
| DRB1*1372 | | | | | |
| DRB1*1373 | | | | | |
| DRB1*1374 | | | | | |
| DRB1*1375 | | | | | |
| DRB1*1376 | | | | | |
| DRB1*1377 | | | | | |
| DRB1*1378 | | | | | |
| DRB1*1379 | | | | | |
| DRB1*1380 | | | | | |
| DRB1*1381 | | | | | |
| DRB1*1382 | | | | | |
| DRB1*1383 | | | | | |
| DRB1*1384 | | | | | |
| DRB1*1385 | | | | | |
| DRB1*1386 | | | | | |
| DRB1*1387 | | | | | |
| DRB1*1388 | | | | | |
| DRB1*1389 | | | | | |
| DRB1*1390 | | | | | |
| DRB1*1391 | | | | | |
| DRB1*1392 | | | | | |
| DRB1*140101 | | | | | |
| DRB1*140102 | | | | | |
| DRB1*140103 | | | | | |
| DRB1*1402 | | | | | |
| DRB1*140301 | | | | | |
| DRB1*140302 | | | | | |
| DRB1*1404 | | | | | |

Fig. 2 cont'd

| | | | | | |
|---|---|---|---|---|---|
| DRB1*140501 | | | | | |
| DRB1*140502 | | | | | |
| DRB1*140503 | | | | | |
| DRB1*1406 | | | | | |
| DRB1*140701 | | | | | |
| DRB1*140702 | | | | | |
| DRB1*1408 | | | | | |
| DRB1*1409 | | | | | |
| DRB1*1410 | | | | | |
| DRB1*1411 | | | | | |
| DRB1*1412 | | | | | |
| DRB1*1413 | | | | | |
| DRB1*1414 | | | | | |
| DRB1*1415 | | | | | |
| DRB1*1416 | | | | | |
| DRB1*1417 | | | | | |
| DRB1*1418 | | | | | |
| DRB1*1419 | | | | | |
| DRB1*1420 | | | | | |
| DRB1*1421 | | | | | |
| DRB1*1422 | | | | | |
| DRB1*142301 | | | | | |
| DRB1*142302 | | | | | |
| DRB1*1424 | | | | | |
| DRB1*1425 | | | | | |
| DRB1*1426 | | | | | |
| DRB1*1427 | | | | | |
| DRB1*1428 | | | | | |
| DRB1*1429 | | | | | |
| DRB1*1430 | | | | | |
| DRB1*1431 | | | | | |
| DRB1*143201 | | | | | |

Fig. 2 cont'd

| | | | | | | |
|---|---|---|---|---|---|---|
| | DRB1*143202 | | | | | |
| | DRB1*1433 | | | | | |
| | DRB1*1434 | | | | | |
| | DRB1*1435 | | | | | |
| | DRB1*1436 | | | | | |
| | DRB1*1437 | | | | | |
| | DRB1*1438 | | | | | |
| | DRB1*1439 | | | | | |
| | DRB1*1440 | | | | | |
| | DRB1*1441 | | | | | |
| | DRB1*1442 | | | | | |
| | DRB1*1443 | | | | | |
| | DRB1*144401 | | | | | |
| | DRB1*144402 | | | | | |
| | DRB1*1445 | | | | | |
| | DRB1*1446 | | | | | |
| | DRB1*1447 | | | | | |
| | DRB1*1448 | | | | | |
| | DRB1*1449 | | | | | |
| | DRB1*1450 | | | | | |
| | DRB1*1451 | | | | | |
| | DRB1*1452 | | | | | |
| | DRB1*1453 | | | | | |
| | DRB1*1454 | | | | | |
| | DRB1*1455 | | | | | |
| | DRB1*1456 | | | | | |
| | DRB1*1457 | | | | | |
| | DRB1*1458 | | | | | |
| | DRB1*1459 | | | | | |
| | DRB1*1460 | | | | | |
| | DRB1*1461 | | | | | |
| | DRB1*1462 | | | | | |

Fig. 2 cont'd

| | | | | | |
|---|---|---|---|---|---|
| DRB1*1463 | | | | | |
| DRB1*1464 | | | | | |
| DRB1*1465 | | | | | |
| DRB1*1467 | | | | | |
| DRB1*1468 | | | | | |
| DRB1*1469 | | | | | |
| DRB1*1470 | | | | | |
| DRB1*1471 | | | | | |
| DRB1*1472 | | | | | |
| DRB1*1473 | | | | | |
| DRB1*1474 | | | | | |
| DRB1*1475 | | | | | |
| DRB1*1476 | | | | | |
| DRB1*1477 | | | | | |
| DRB1*1478 | | | | | |
| DRB1*1479 | | | | | |
| DRB1*1480 | | | | | |
| DRB1*1481 | | | | | |
| DRB1*1482 | | | | | |
| DRB1*1483 | | | | | |
| DRB1*1484 | | | | | |
| DRB1*1485 | | | | | |
| DRB1*1486 | | | | | |
| DRB1*1487 | | | | | |
| DRB1*1488 | | | | | |
| DRB1*1489 | | | | | |
| DRB1*1490 | | | | | |
| DRB1*15010101 | | | | | |
| DRB1*15010102 | | | | | |
| DRB1*150102 | | | | | |
| DRB1*150103 | | | | | |
| DRB1*150104 | | | | | |

Fig. 2 cont'd

| | | | | | |
|---|---|---|---|---|---|
| DRB1*150105 | | | | | |
| DRB1*150106 | | | | | |
| DRB1*150201 | | | | | |
| DRB1*150202 | | | | | |
| DRB1*150203 | | | | | |
| DRB1*150204 | | | | | |
| DRB1*150205 | | | | | |
| DRB1*150206 | | | | | |
| DRB1*15030101 | | | | | |
| DRB1*15030102 | | | | | |
| DRB1*1504 | | | | | |
| DRB1*1505 | | | | | |
| DRB1*1506 | | | | | |
| DRB1*1507 | | | | | |
| DRB1*1508 | | | | | |
| DRB1*1509 | | | | | |
| DRB1*1510 | | | | | |
| DRB1*1511 | | | | | |
| DRB1*1512 | | | | | |
| DRB1*1513 | | | | | |
| DRB1*1514 | | | | | |
| DRB1*1515 | | | | | |
| DRB1*1516 | | | | | |
| DRB1*1517N | | | | | |
| DRB1*1518 | | | | | |
| DRB1*1519 | | | | | |
| DRB1*1520 | | | | | |
| DRB1*1521 | | | | | |
| DRB1*1522 | | | | | |
| DRB1*1523 | | | | | |
| DRB1*1524 | | | | | |
| DRB1*1525 | | | | | |

Fig. 2 cont'd

| | | | | | |
|---|---|---|---|---|---|
| | DRB1*1526 | | | | |
| | DRB1*1527 | | | | |
| | DRB1*1528 | | | | |
| | DRB1*1529 | | | | |
| | DRB1*1530 | | | | |
| | DRB1*1531 | | | | |
| | DRB1*1532 | | | | |
| | DRB1*1533 | | | | |
| | DRB1*160101 | | | | |
| | DRB1*160102 | | | | |
| | DRB1*160201 | | | | |
| | DRB1*160202 | | | | |
| | DRB1*1603 | | | | |
| | DRB1*1604 | | | | |
| | DRB1*160501 | | | | |
| | DRB1*160502 | | | | |
| | DRB1*1607 | | | | |
| | DRB1*1608 | | | | |
| | DRB1*1609 | | | | |
| | DRB1*1610 | | | | |
| | DRB1*1611 | | | | |
| | DRB1*1612 | | | | |
| | DRB1*1613N | | | | |

Fig. 2 cont'd

Figure 8 <SEQ. ID: 9583>

MPMGSLQPLATLYLLGMLVASVLAVEQLWVTVYYGVPVWKEATTTLFCASDAKAYDTEVHNV
WATHACVPTDPNPQEVKLENVTENFNMWKNNMVEQMHEDIISLWDQSLKPCVKLTPLCVTL
NCTDLRNATNTTSSSWETMEKGEIKNCSFNITTSIRDKVQKEYALFYNLDVVPIDNASYRLISCNT
SVITQACPKVSFEPIPIHYCAPAGFAILKCNDKKFNGTGPCTNVSTVQCTHGIRPVVSTQLLLNGS
LAEEEIVIRSENFTNNAKTIIVQLNESVVINCTRPNNNTRKSINIGPGRALYTTGEIIGDIRQAHCNL
SKTQWENTLEQIAIKLKEQFGNNKTIIFNPSSGGDPEIVTHSFNCGGEFFYCNSTQLFTWNDTRK
LNNTGRNITLPCRIKQIINMWQEVGKAMYAPPIRGQIRCSSNITGLLLTRDGGKDTNGTEIFRPG
GGDMRDNWRSELYKYKVVKIEPLGVAPTKAKRRVVQSEKSAVGLGALFLGFLGAAGSTMGAA
SITLTVQARQLLSGIVQQQNNLLRAIEAQQHLLQLTVWGIKQLQARVLAVERYLRDQQLLGIW
GCSGKLICTTTVPWNTSWSNKSLNEIWDNMTWMKWEREIDNYTHIIYSLIEQSQNQQEKNEQ
ELLALDKWASLWNWFDITKWLWYIKGSGYIPEAPRDGQAYVRKDGEWVLLSTFLPP

Figure 9 <SEQ. ID: 9584>

WVKLVEEKKFGAEVVPGFQALSGGCTPYDINQMLNCVGEHQAAMQIIREIINEEAADWDLQH
PQPGPIPAGQLRDPRGSDIAGTTSTVEEQIQWMYRQQNPIPVGNIYRRWIQLGLQKCVRMYN
PTNILDVKQGPKEPFQ

A
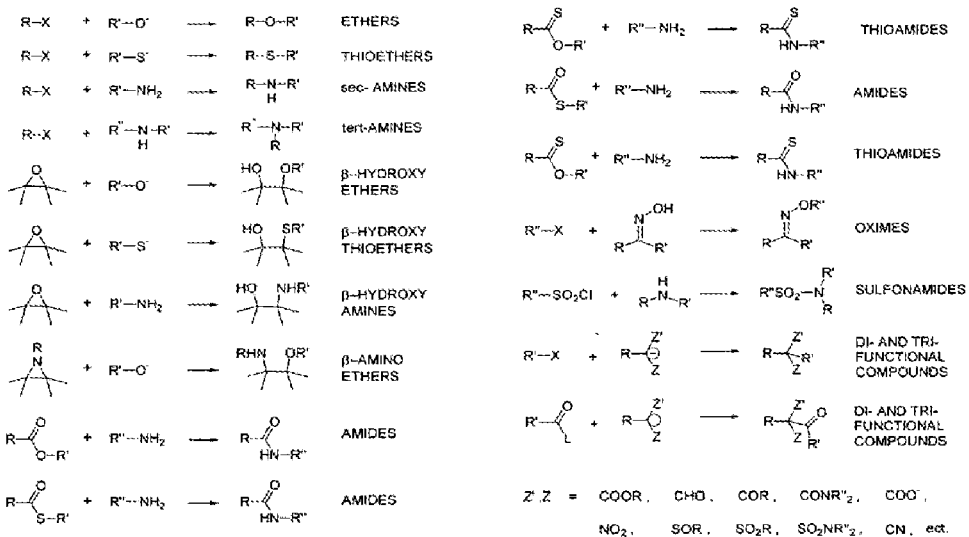
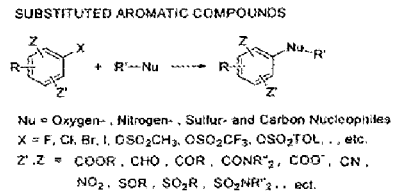
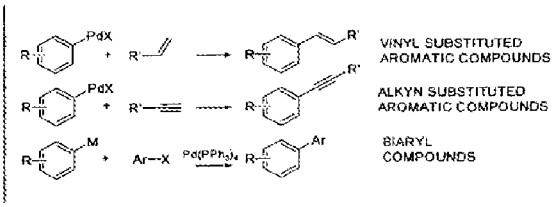
Figure 10: Reactive groups and the bonds formed upon their reaction.

B
Addition to carbon-carbon multiplebonds
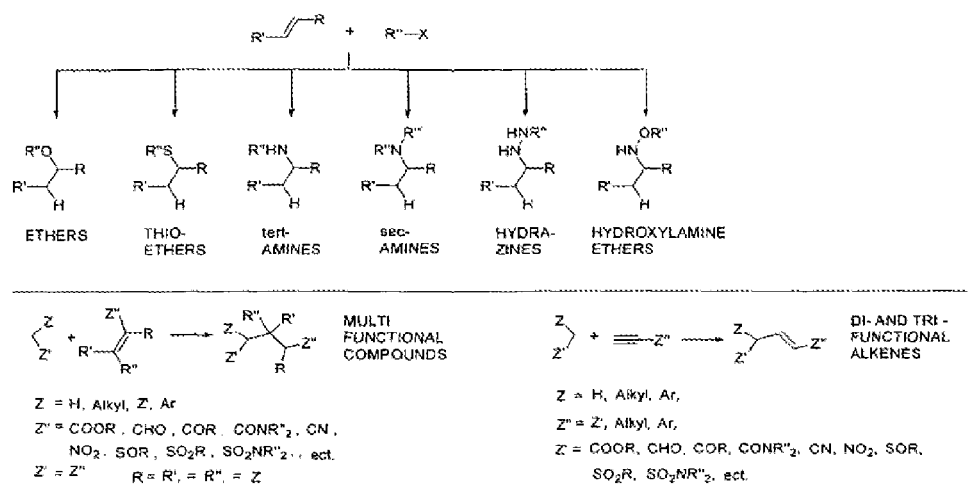
Cycloaddition to multiple bounds
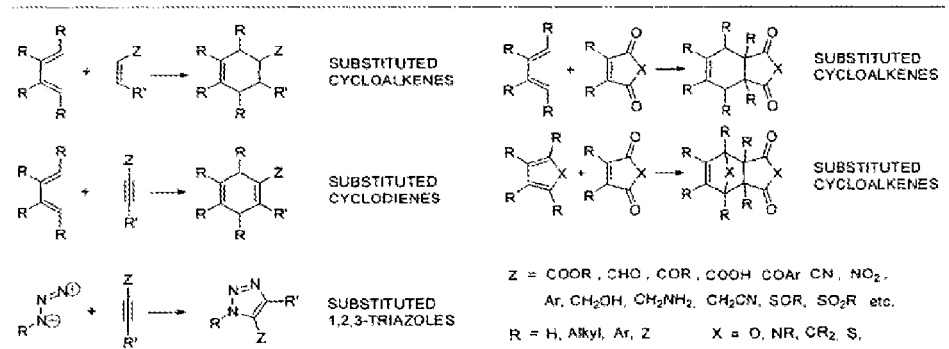
Figure 10, continued: Reactive groups and the bonds formed upon their reaction.

C
Addition to carbon-hetero multiple bonds
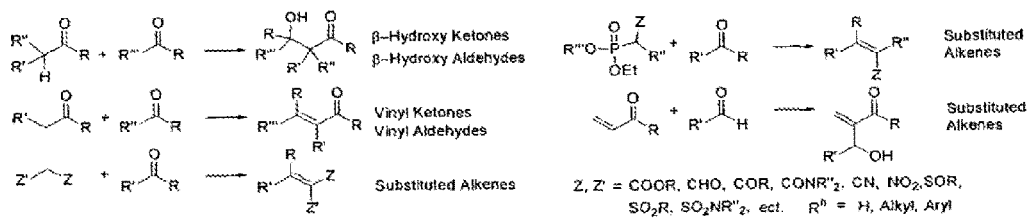
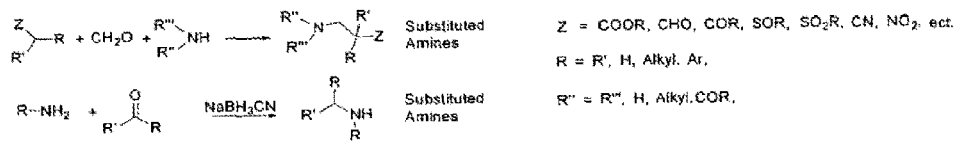
Figure 10, continued. Reactive groups and the bonds formed upon their reaction.

MOLECULAR VACCINES FOR INFECTIOUS DISEASE

All patent and non-patent references cited in the present application are hereby incorporated by reference in their entirety. The content of PCT/D2002/000169 is hereby incorporated by reference in this application.

The Danish patent application PA 2008 01384, and the US provisional patent application U.S. 61/102,126 are hereby incorporated by reference in its entirety.

All patent and non-patent references cited in PA 2008 01384, and U.S. 61/102,126, or in the present application, are also hereby incorporated by reference in their entirety.

The European patent application EP 09154516.0, the PCT patent applications PCT/DK2009/050185 and PCT/DK2008/050167 are hereby incorporated by reference in its entirety.

All patent and non-patent references cited in EP 09154516.0, PCT/DK2009/050185 and PCT/DK2008/050167, are also hereby incorporated by reference in their entirety.

FIELD OF INVENTION

The present invention relates to methods for construction of pharmamers i.e. vaccine components characterized by their multimerization domain and the attached biologically active molecules, and their use in preparation of vaccines that contains the pharmamers alone or in combination with other molecules. The individual molecules of the construct can be bound to each other or the multimerization domain(s) by covalent or non-covalent bonds, directly or via linkers. In one embodiment the one or more pharmamers comprises one or more MHC multimers disclosed in PCT/D2002/000169. Some of the molecules in the vaccine may be free i.e. non-attached to the pharmamer itself. The invention further relates to the use of such preparations in vaccine settings aimed to function as preventive/prophylactic or therapeutic vaccines in humans and animals.

BACKGROUND OF INVENTION

By having functional molecules coupled to the vaccine antigen(s) as in pharmamers presentation of the antigen(s) to the immune system may be directed, enforced or otherwise modified. This can be accomplished by directing the antigens to specific antigen presenting cells by means of co-coupled receptor molecules or ligands.

SUMMARY OF INVENTION

The present invention relates to a composition for vaccination and/or immune monitoring of a vaccine response comprising one or more pharmamers.

In another embodiment the present invention relates to a method of making the composition for vaccination and/or immune monitoring of a vaccine response comprising one or more pharmamers.

This invention also relates to a method for vaccination comprising administration to an individual in need thereof an effective amount of a composition comprising one or more pharmamers.

The invention further relates to a method for monitoring a vaccine response comprising use of the composition comprising one or more pharmamers.

In a further aspect the invention relates to a kit-of-parts comprising a composition comprising one or more pharmamers and use for this kit-of-parts for vaccination of an individual in need thereof or for monitoring of a vaccine response.

In one embodiment the present invention relates to methods for construction of pharmamers characterized by their multimerization domain and the attached biologically active molecules, and their use in preparation of vaccines that contains the pharmamers alone or in combination with other molecules.

Definitions

Adjuvant: As used herein, the term "adjuvant" refers to an immunological adjuvant. By this is meant a compound that is able to enhance or facilitate the immune system's response to the ingredient in question, thereby inducing an immune response or series of immune responses in the subject. The adjuvant can facilitate the effect of the therapeutic composition by forming depots (prolonging the half-life of the ingredient), provide additional T-cell help and stimulate cytokine production. Facilitation of antigen survival and unspecific stimulation by adjuvants may, in some cases, be required if the antigenic molecule epitopes or functional molecules of the pharmamer are only weakly antigenic or only exerts weak to moderate interactions with compounds, molecules, or cells of the immune system.

Antibodies: As used herein, the term "antibody" means an isolated or recombinant binding agent that comprises the necessary variable region sequences to specifically bind an antigenic epitope. Therefore, an antibody is any form of antibody or fragment thereof that exhibits the desired biological activity, e.g., binding the specific target antigen. Antibodies can derive from multiple species. For example, antibodies include rodent (such as mouse and rat), rabbit, sheep, camel, and human antibodies. Antibodies can also include chimeric antibodies, which join variable regions from one species to constant regions from another species. Likewise, antibodies can be humanized, that is constructed by recombinant DNA technology to produce immunoglobulins which have human framework regions from one species combined with complementarity determining regions (CDR's) from a another species' immunoglobulin. The antibody can be monoclonal or polyclonal. Antibodies can be divided into isotypes (IgA, IgG, IgM, IgD, IgE, IgG1, IgG2, IgG3, IgG4, IgA1, IgA2, IgM1, IgM2). In another embodiment the term "antibody" refers to an intact antibody, or a fragment of an antibody that competes with the intact antibody for antigen binding. In certain embodiments, antibody fragments are produced by recombinant DNA techniques. In certain embodiments, antibody fragments are produced by enzymatic or chemical cleavage of intact antibodies. Exemplary antibody fragments include, but are not limited to, Fab, Fab', F(ab')2, Fv, and scFv. Exemplary antibody fragments also include, but are not limited to, domain antibodies, nanobodies, minibodies ((scFv-CH$_3$)$_2$), maxibodies ((scFv-CH$_2$—CH$_3$)$_2$), diabodies (noncovalent dimer of scFv).

Antigen presenting cell: An antigen-presenting cell (APC) as used herein is a cell that displays foreign antigen complexed with MHC on its surface.

Antigenic peptide: Any peptide molecule that is bound to or able to bind into the binding groove of either MHC I or MHC II molecules.

Avidin: Avidin as used herein is a glycoprotein found in the egg white and tissues of birds, reptiles and amphibians. It contains four identical subunits having a combined mass of 67,000-68,000 daltons. Each subunit consists of 128 amino acids and binds one molecule of biotin.

Biologically active molecules: Any molecule having biological activity. Biologically active molecules of the present invention may be attached to pharmamers, adjuvants, other biologically active molecules and/or vaccine enhancers by covalent or non-covalent interaction or they may be individual component(s) of the composition. Biologically active molecules in a pharmamer affect the binding characteristics and/or the effects of the pharmamer.

Biotin: Biotin, as used herein, is also known as vitamin H or $B_7$. Biotin has the chemical formula $C_{10}H_{16}N_2O_3S$.

Covalent binding: The term covalent binding is used herein to describe a form of chemical bonding that is characterized by the sharing of pairs of electrons between atoms. Attraction-to-repulsion stability that forms between atoms when they share electrons is known as covalent bonding.

Crosslinking: Crosslinking is the process of chemically joining two or more molecules by a covalent bond. Crosslinking reagents contain reactive ends to specific functional groups (primary amines, sulfhydryls, etc.) on proteins or other molecules.

Dendritic cell: The term dendritic cell as used herein is a type of immune cells. Their main function is to process antigen material and present it on the surface to other cells of the immune system, thus functioning as antigen-presenting cells.

Immunologically active molecules: Immunologically active molecule is used interchangeably herein with immuno active molecule and is any molecule that as an active part of the pharmamer, pharmamer composition, vaccine or therapeutics is modulating the immuno-activity of the pharmamer, pharmamer composition, vaccine or therapeutics itself or the immune system as such.

Carrier: A carrier as used herein can be any type of molecule that is directly or indirectly associated with a biologically active molecule. A carrier may link biologically active molecules to multimerisation domains and/or be a multimerisation domain itself.

Dextran: the term dextran as used herein is a complex, branched polysaccharide made of many glucose molecules joined into chains of varying lengths. The straight chain consists of α1→6 glycosidic linkages between glucose molecules, while branches begin from α1→3 linkages (and in some cases, α1→2 and α1→4 linkages as well).

Linker molecule: Linker molecule and linker is used interchangeable herein. A linker molecule is a molecule that covalently or non-covalently connects two or more molecules, thereby creating a larger complex consisting of all molecules including the linker molecule.

Liposomes: The term liposome as used herein is defined as a spherical vesicle with a membrane composed of a phospholipid and cholesterol bilayer. Liposomes, usually but not by definition, contain a core of aqueous solution; lipid spheres that contain no aqueous material are called micelles.

MHC: Denotes the major histocompatibility complex.

A "MHC Class I molecule" as used everywhere herein is defined as a molecule which comprises 1-3 subunits, including a heavy chain, a heavy chain combined with a light chain ($beta_2m$), a heavy chain combined with a light chain ($beta_2m$) through a flexible linker, a heavy chain combined with a peptide, a heavy chain combined with a peptide through a flexible linker, a heavy chain/$beta_2m$ dimer combined with a peptide, and a heavy chain/$beta_2m$ dimer with a peptide through a flexible linker to the heavy or light chain. The MHC molecule chain can be changed by substitution of single or by cohorts of native amino acids or by inserts, or deletions to enhance or impair the functions attributed to said molecule. By example, it has been shown that substitution of XX with YY in position nn of human $beta_2m$ enhance the biochemical stability of MHC Class I molecule complexes and thus can lead to more efficient antigen presentation of subdominant peptide epitopes.

MHC complex: MHC complex is herein used interchangeably with MHC-peptide complex, unless it is specified that the MHC complex is empty, i.e. is not complexed with peptide.

MHC Class I like molecules (including non-classical MHC Class I molecules) include CD1d, HLA E, HLA G, HLA F, HLA H, MIC A, MIC B, ULBP-1, ULBP-2, and ULBP-3. A "MHC Class II molecule" as used everywhere herein is defined as a molecule which comprises 2-3 subunits including an alpha-chain and a beta-chain (alpha/beta-dimer), an alpha/beta dimer with a peptide, and an alpha/beta dimer combined with a peptide through a flexible linker to the alpha or beta chain, an alpha/beta dimer combined through an interaction by affinity tags e.g. jun-fos, an alpha/beta dimer combined through an interaction by affinity tags e.g. jun-fos and further combined with a peptide through a flexible linker to the alpha or beta chain. The MHC molecule chains can be changed by substitution of single or by cohorts of native amino acids or by inserts, or deletions to enhance or impair the functions attributed to said molecule. Under circumstances where the alpha-chain and beta-chain have been fused, to form one subunit, the "MHC Class II molecule" can comprise only 1 subunit.

MHC Class II like molecules (including non-classical MHC Class II molecules) include HLA DM, HLA DO, I-A beta2, and I-E beta2.

"MHC complexes" and "MHC constructs" are used interchangably herein.

"MHC protein" and "MHC molecule" are used interchangably herein. Accordingly, a functional MHC peptide complex comprises a MHC protein or MHC molecule associated with a peptide to be presented for cells or binding partners having an affinity for said peptide.

By the terms "MHC complexes" and "MHC multimers" as used herein are meant such complexes and multimers thereof, which are capable of performing at least one of the functions attributed to said complex or multimer. The terms include both classical and non-classical MHC complexes. The meaning of "classical" and "non-classical" in connection with MHC complexes is well known to the person skilled in the art. Non-classical MHC complexes are subgroups of MHC-like complexes. The term "MHC complex" includes MHC Class I molecules, MHC Class II molecules, as well as MHC-like molecules (both Class I and Class II), including the subgroup non-classical MHC Class I and Class II molecules.

The MHC molecule can suitably be a vertebrate MHC molecule such as a human, a mouse, a rat, a porcine, a bovine or an avian MHC molecule. Such MHC complexes from different species have different names. E.g. in humans, MHC complexes are denoted HLA. The person skilled in the art will readily know the name of the MHC complexes from various species.

MHC multimer: Any molecule complex comprising one or more MHC molecules held together by a multimerization domain. The attachment of MHC molecule to multimerization domain may be directly or in-directly via a linker and may be covalent or non-covalent.

Multimerization domain: A multimerization domain is a molecule, a complex of molecules, a cell, cell-like structure or a solid support, to which one or more biologically active molecules can be attached. A multimerization domain may consist of one or more carriers and/or one or more scaffolds and may also contain one or more linkers connecting carrier to scaffold, carrier to carrier, scaffold to scaffold.

Multimerization domains thus include polymers, proteins (e.g. IgG, streptavidin, TCR, scaffold proteins) micelles, cells, beads, other types of solid support, small organic molecules carrying reactive groups or carrying chemical motifs that can bind biologically active molecules or any other type of multimerization domain as described elsewhere herein.

Non-covalent: The term noncovalent bond as used herein is a type of chemical bond, that does not involve the sharing of pairs of electrons, but rather involves more dispersed variations of electromagnetic interactions.

Nonsense peptide: A peptide that binds efficiently to the peptide binding groove of MHC protein, but that does not support binding of the resultant MHC-peptide complex to desired TCR "One or more" as used everywhere herein is intended to include one and a plurality.

Pharmamer: Molecule or molecule complex comprising one or more multimerisation domain(s) and one or more biologically active molecules.

"A plurality" as used everywhere herein should be interpreted as two or more.

Streptavidin: Streptavidin as used herein is a tetrameric protein purified from the bacterium *Streptomyces avidinii*. Streptavidin is widely use in molecular biology through its extraordinarily strong affinity for biotin.

Vaccine: As used herein the term vaccine is used for an antigenic preparation used to establish partial or total immunity to a disease or illness and thereby protecting, curing or treating the body from a specific disease or illness. Vaccines are either prophylactic and prevent disease or therapeutic and treat disease. Vaccines may contain more than one type of antigen and is then called a combined vaccine.

Vaccination: The introduction of vaccine into the body of human or animals for the purpose of inducing immunity.

Treatment: As used herein, the term "treatment" refers to prophylactic, ameliorating, therapeutic or curative treatment.

FIGURE LEGENDS

Figure 1:
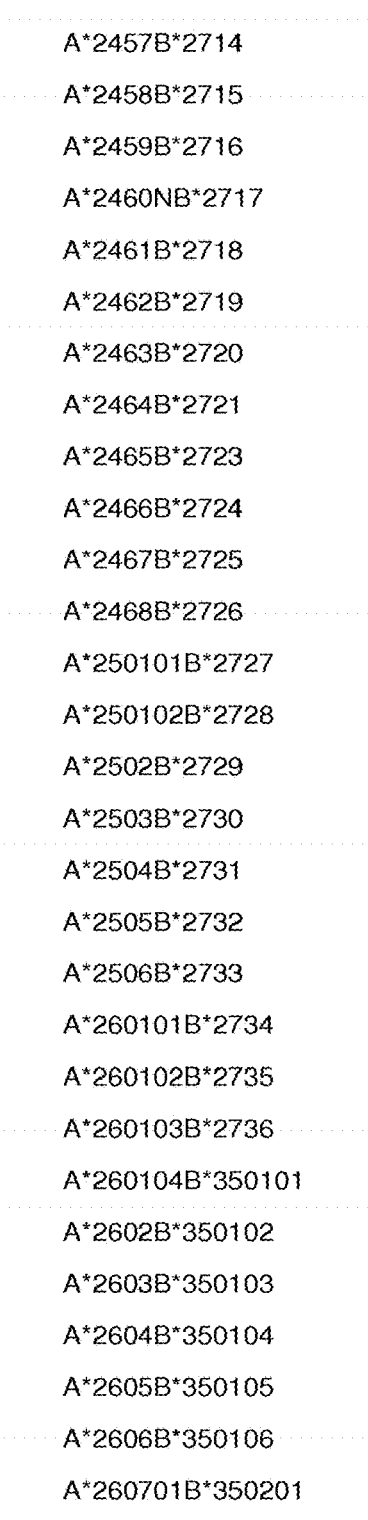
Figure 1:
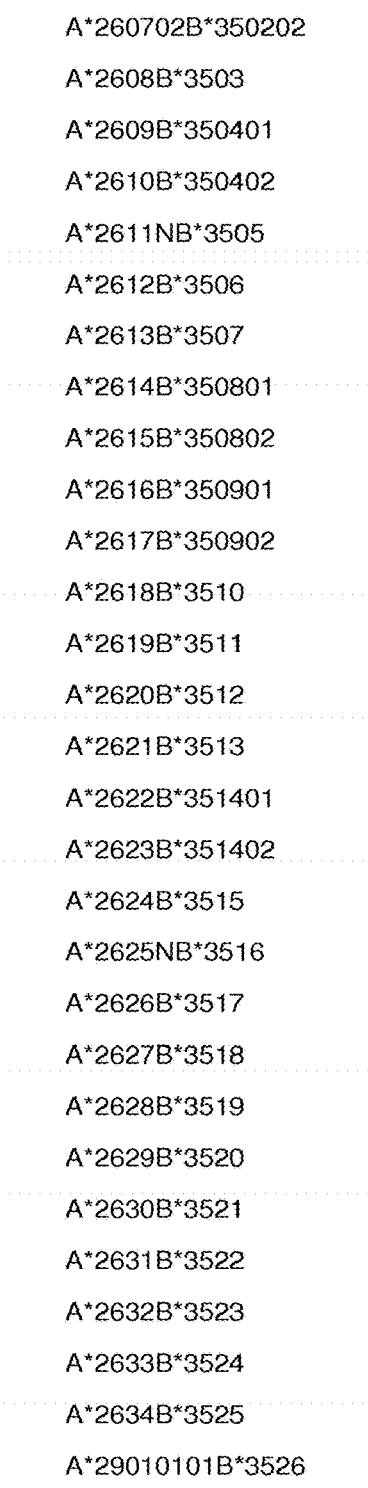
Figure 1:
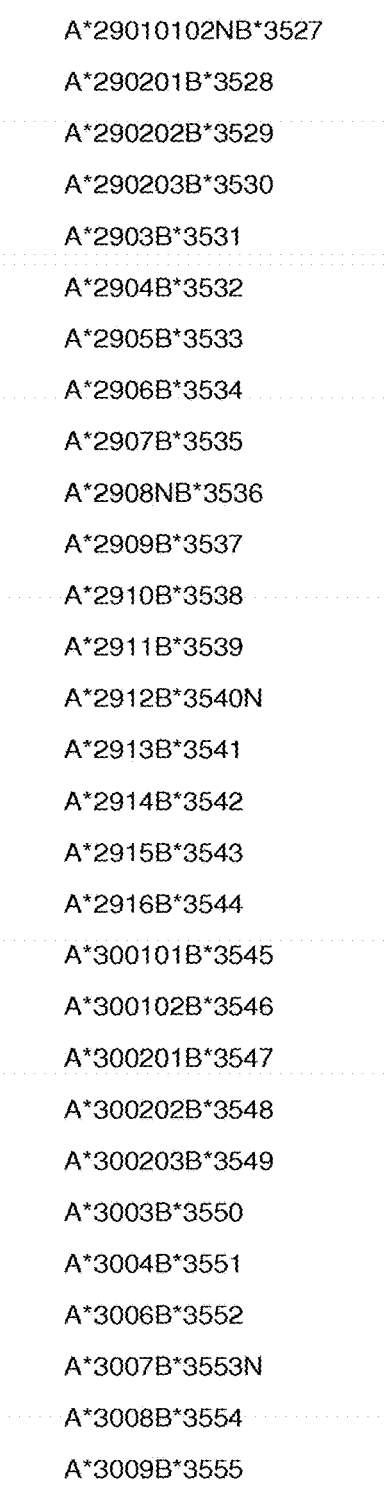
Figure 1:
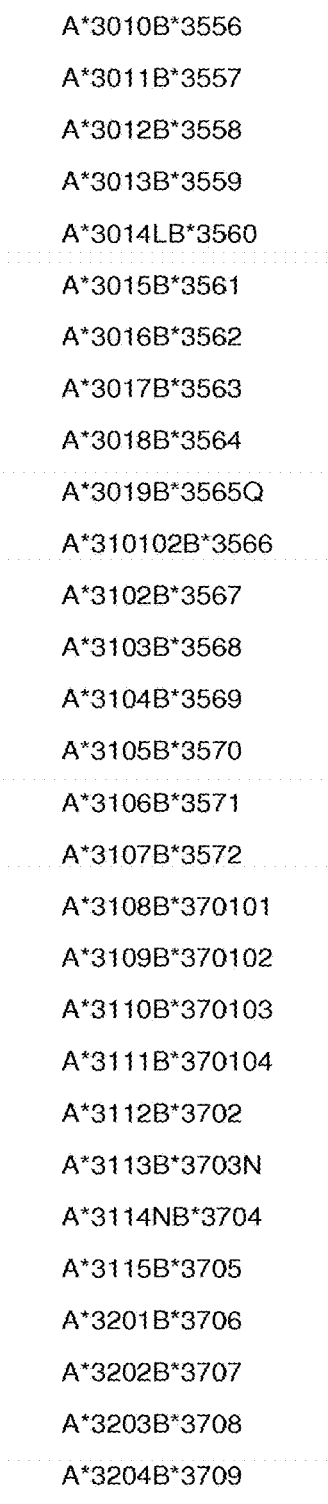
Figure 1:
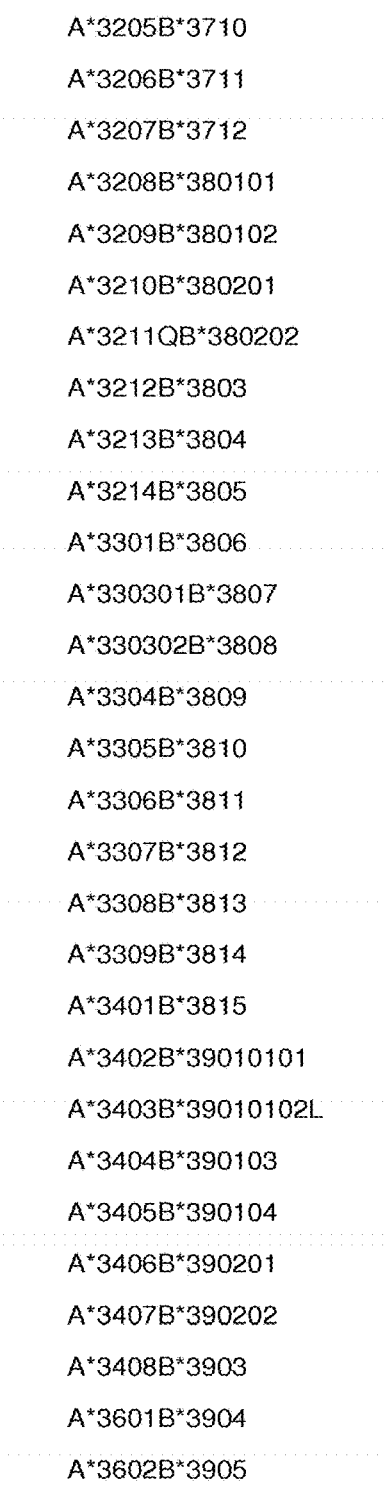
Figure 1:
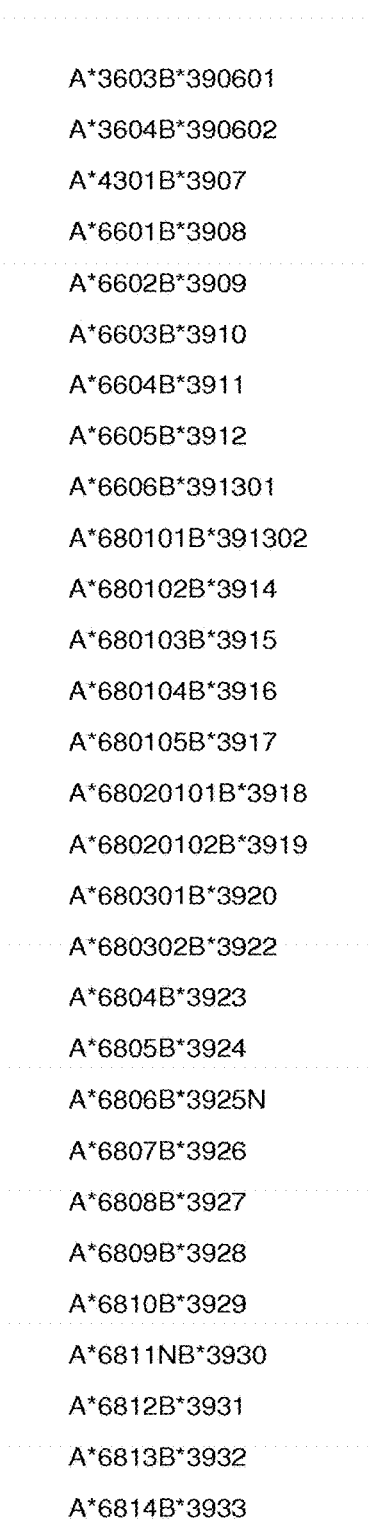
Figure 1:
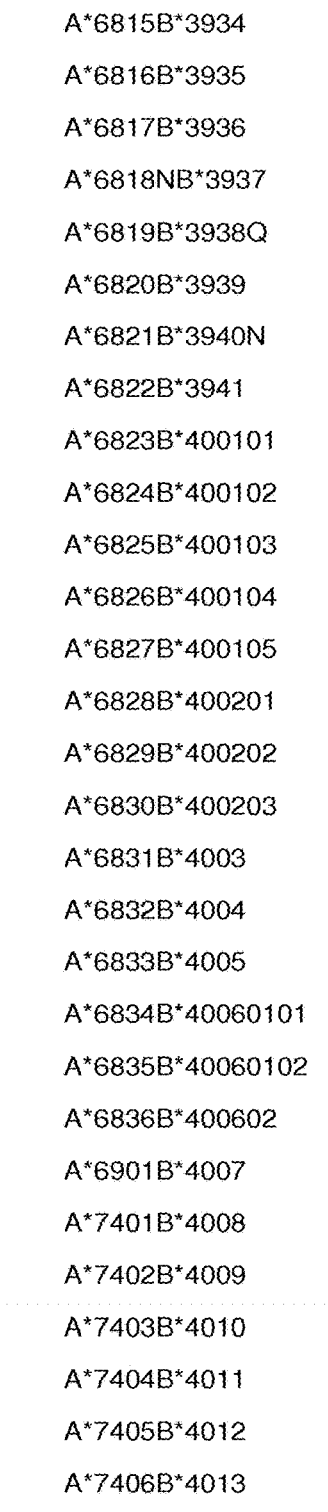
Figure 1:
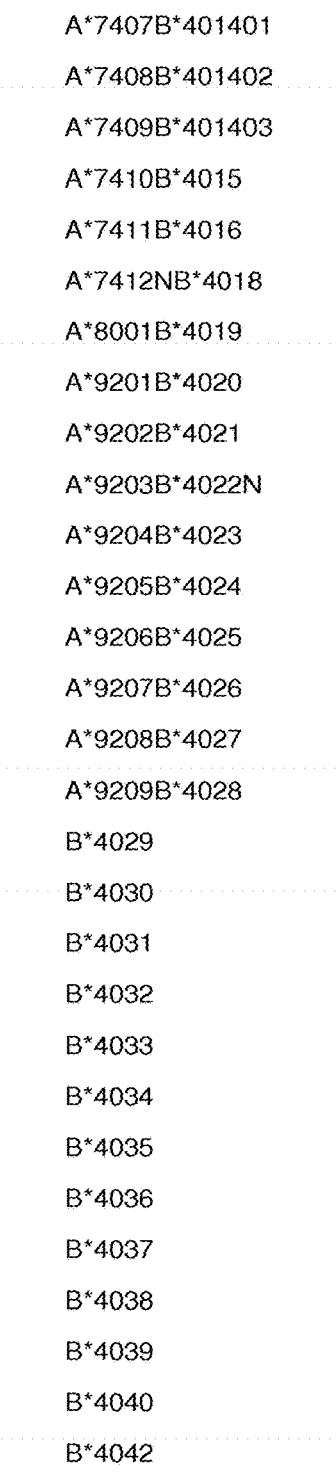
Figure 1:
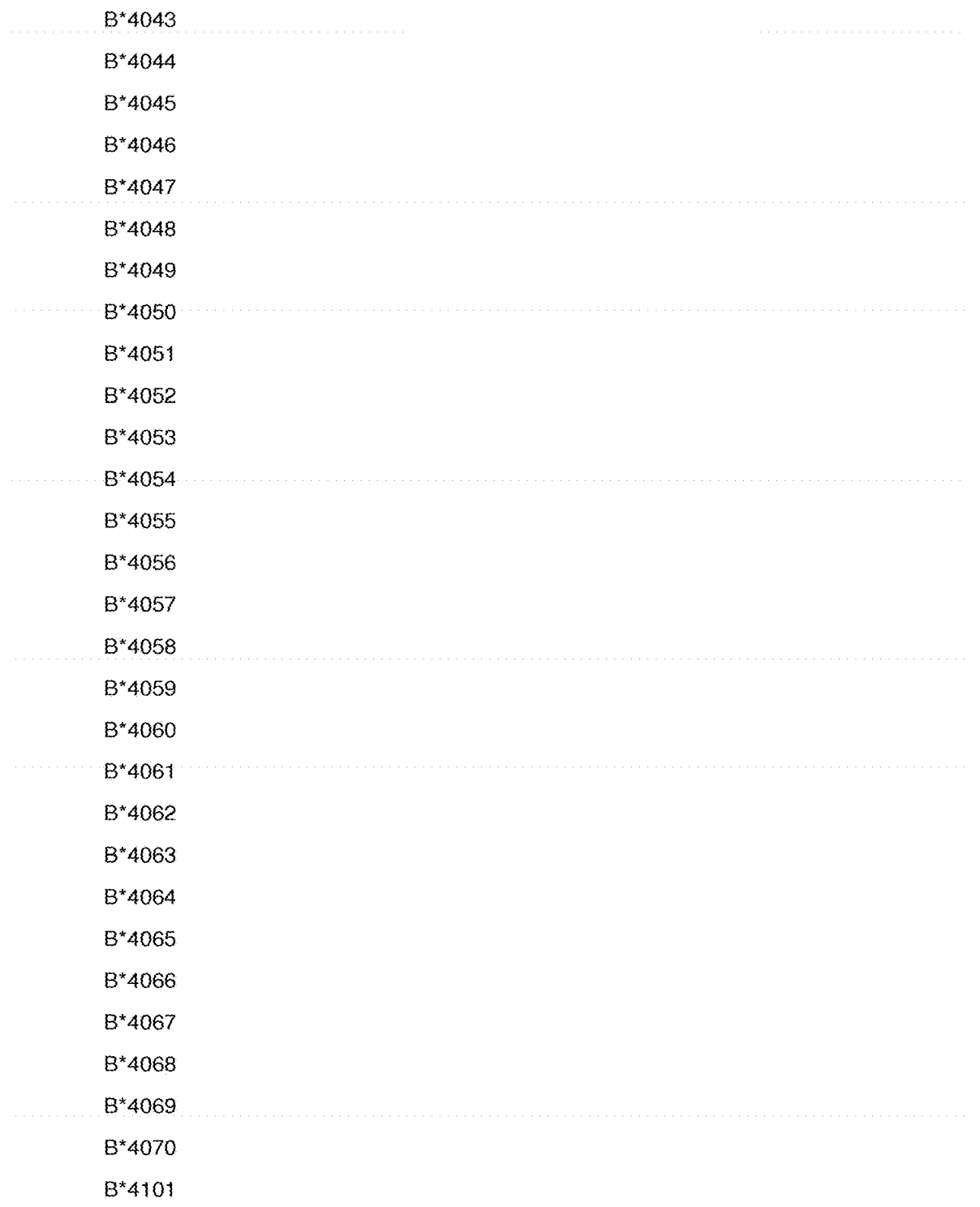
Figure 1:
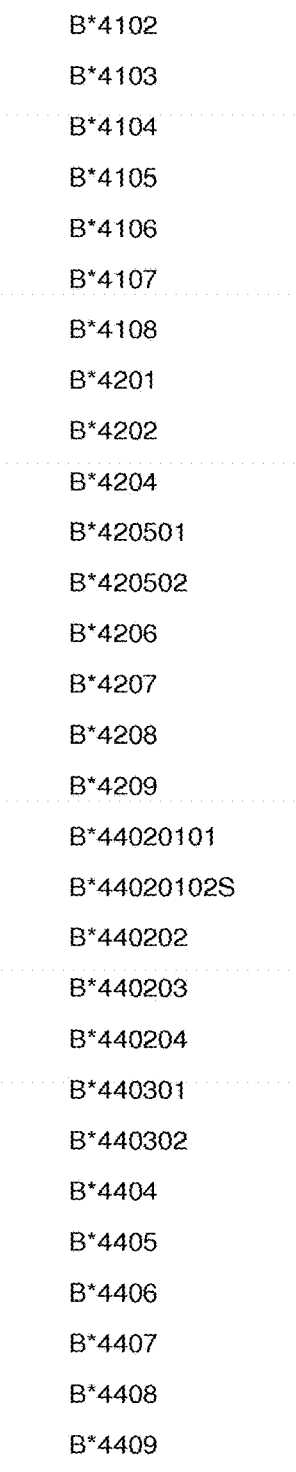
Figure 1:
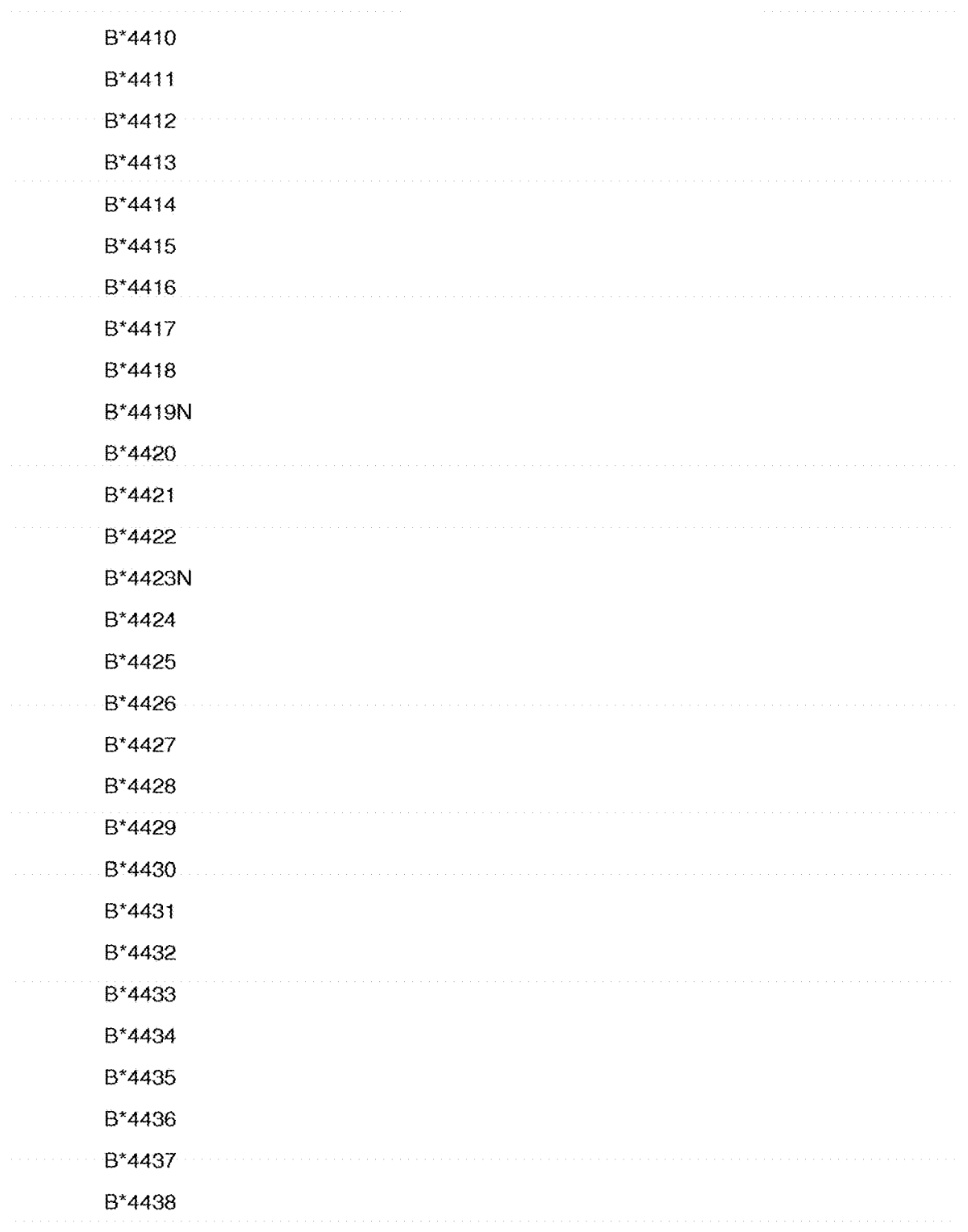
Figure 1:
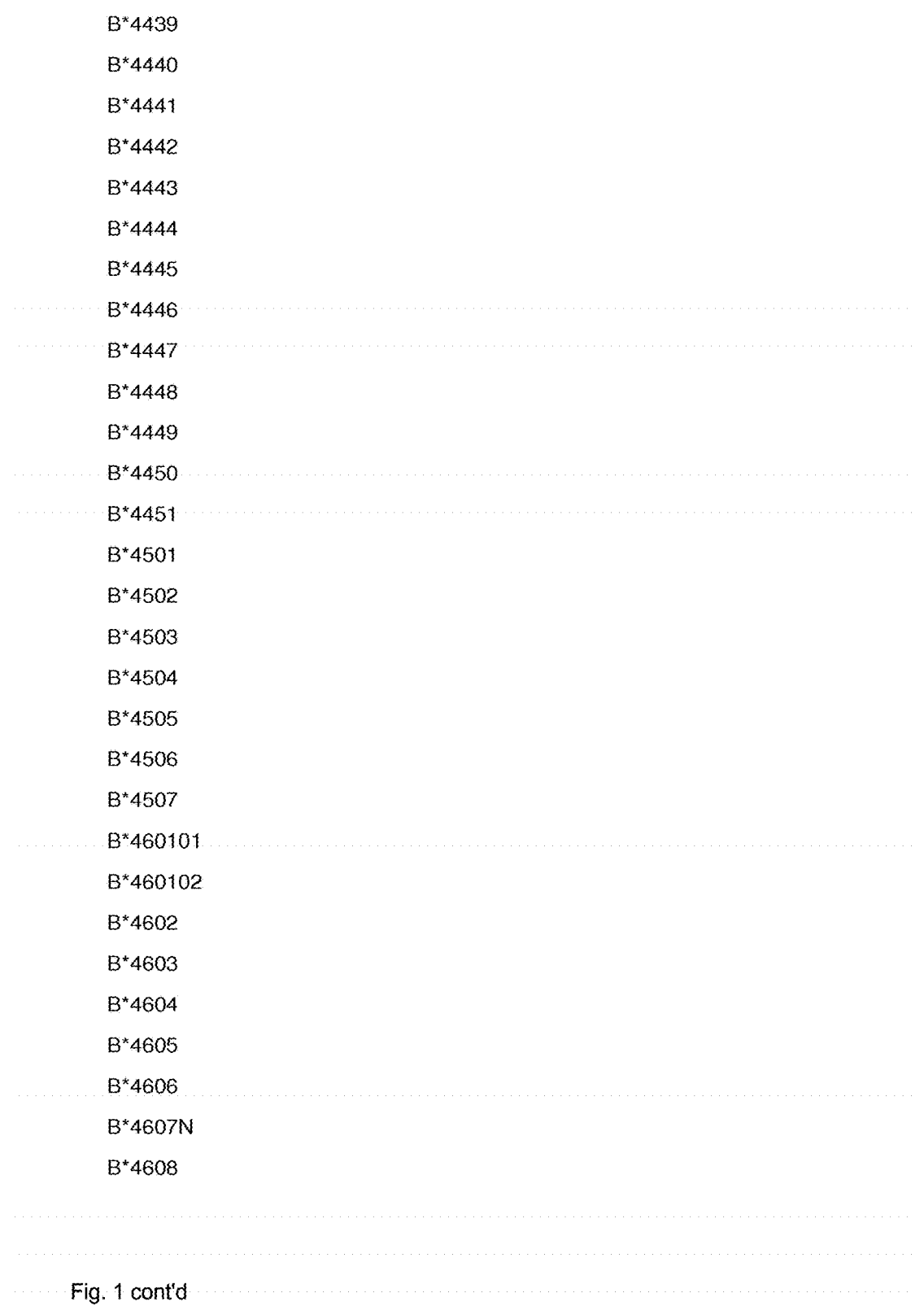
Figure 1:
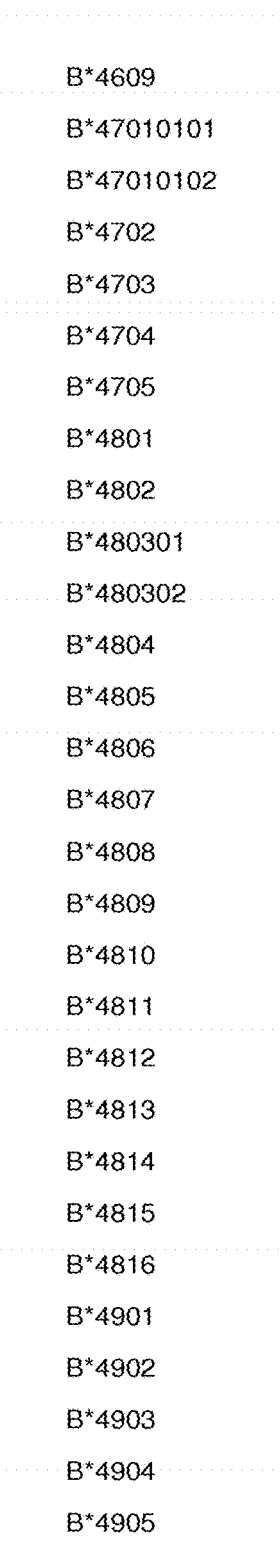
Figure 1:
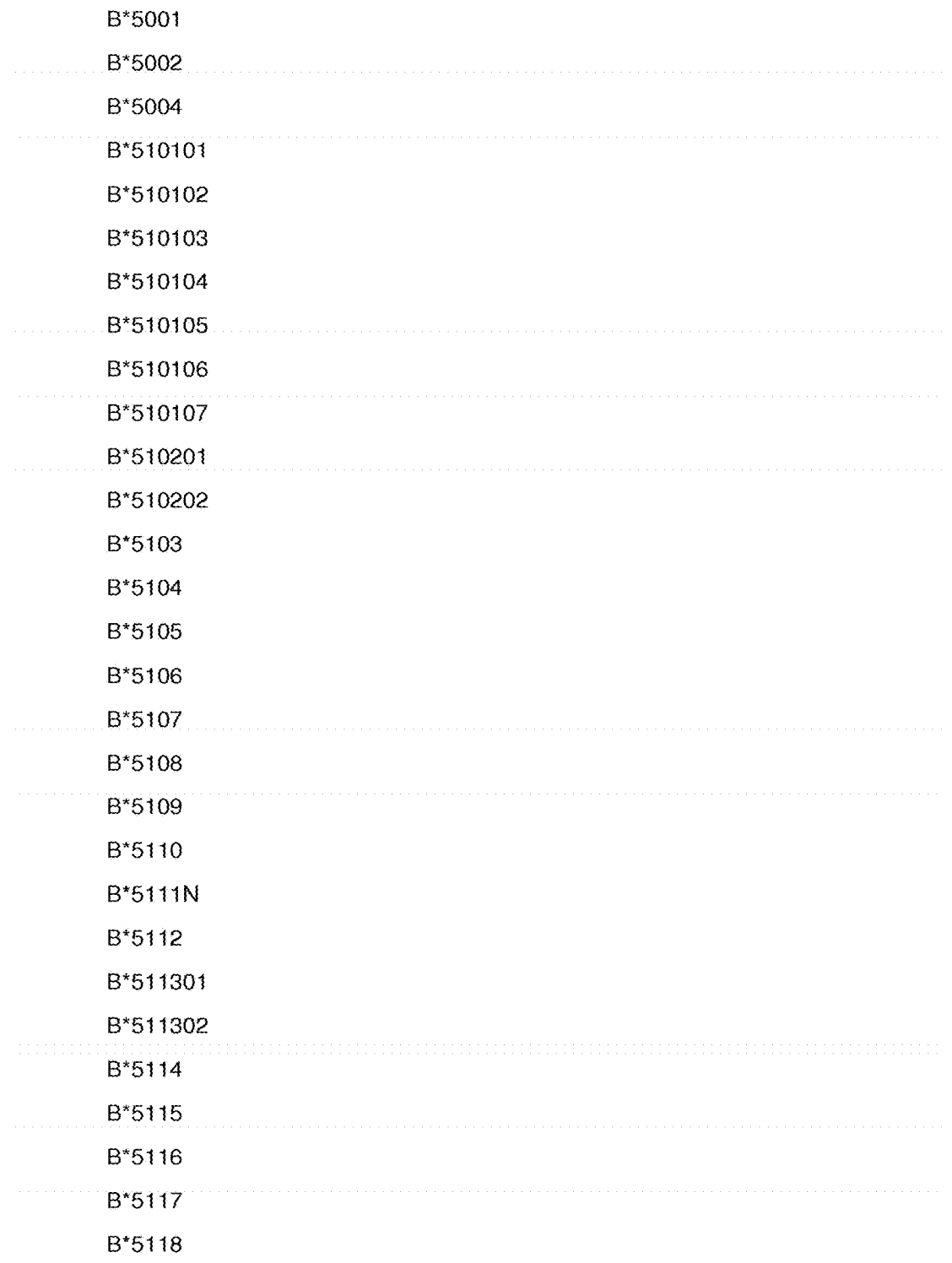
Figure 1:
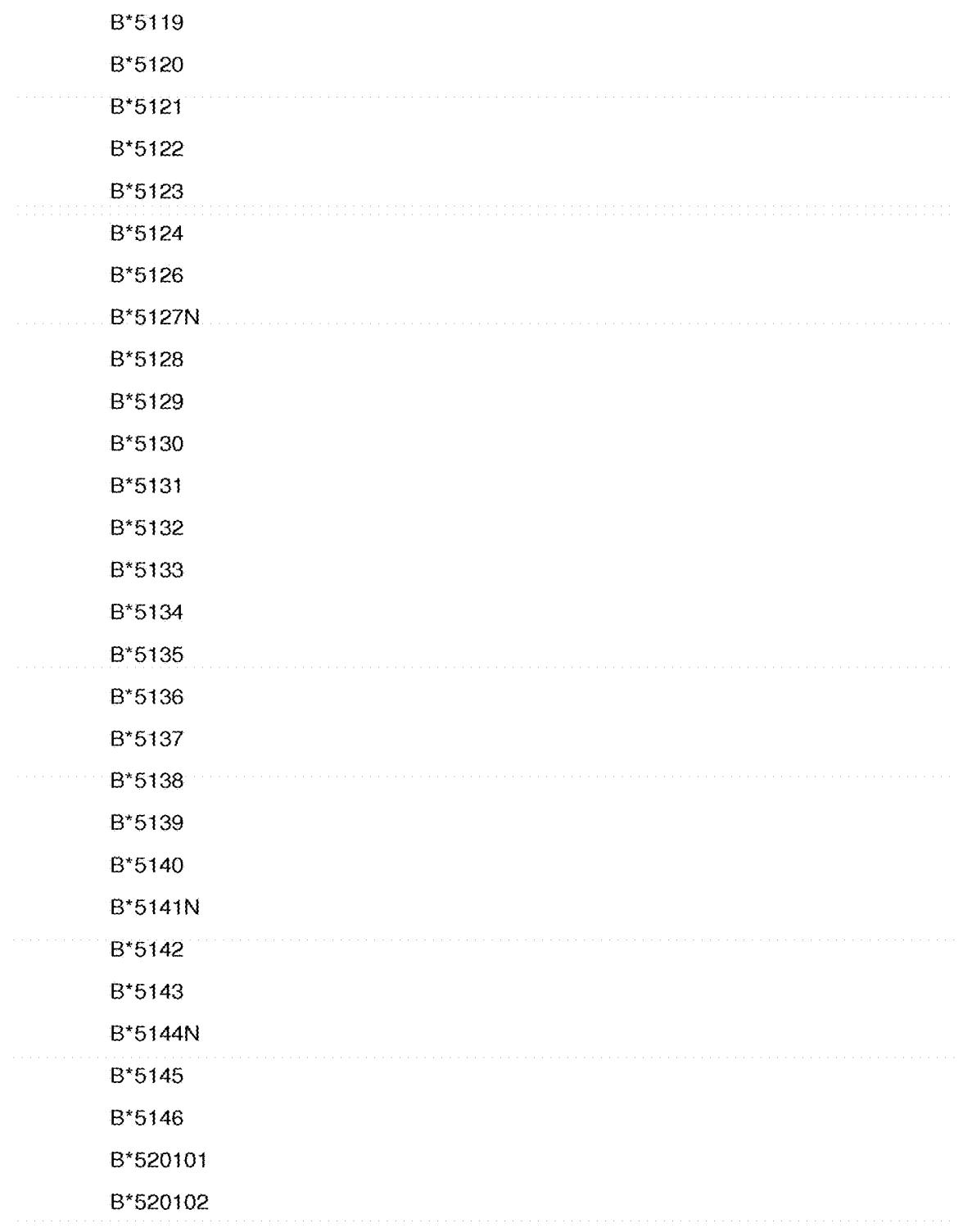
Figure 1:
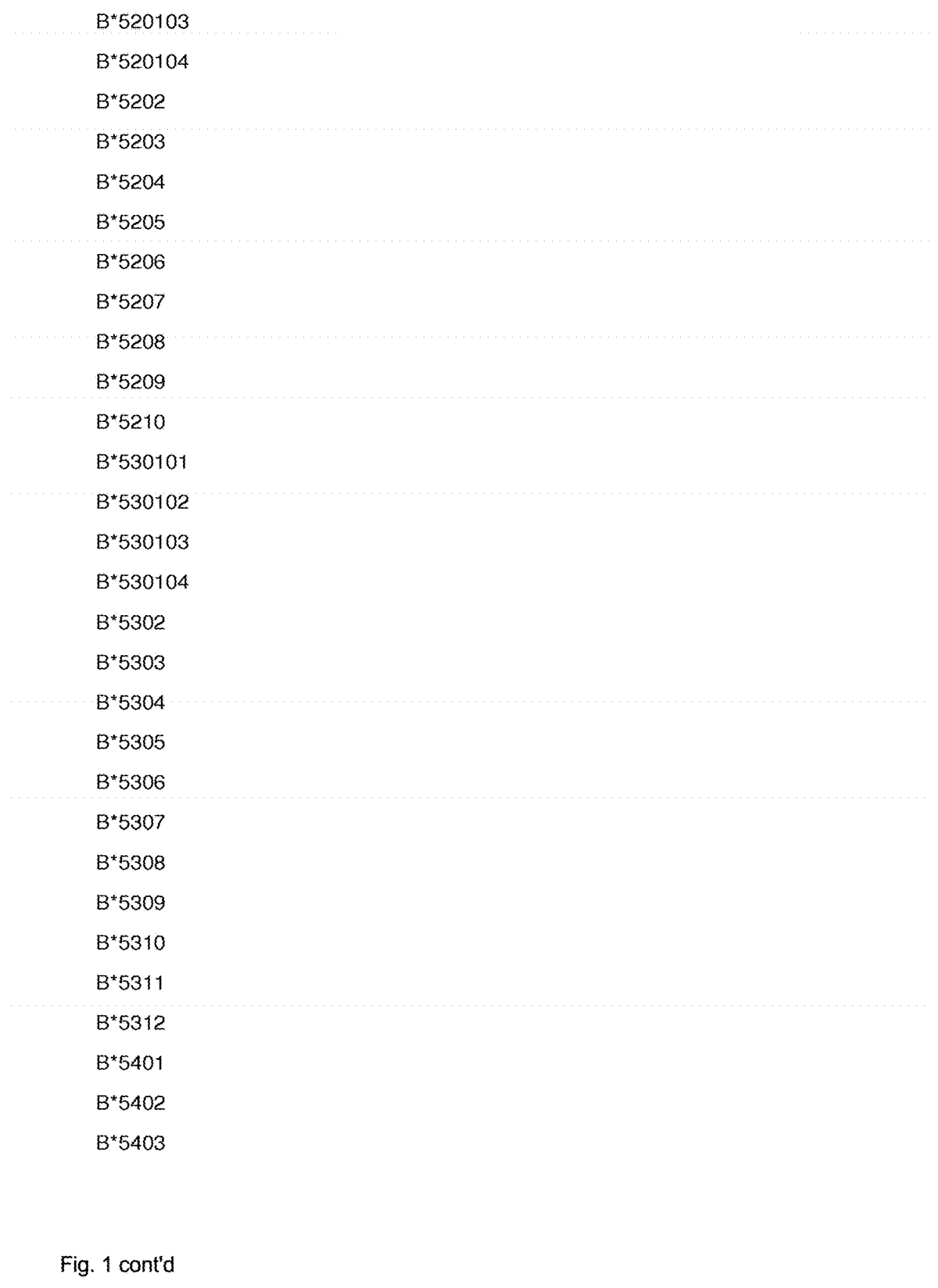
Figure 1:
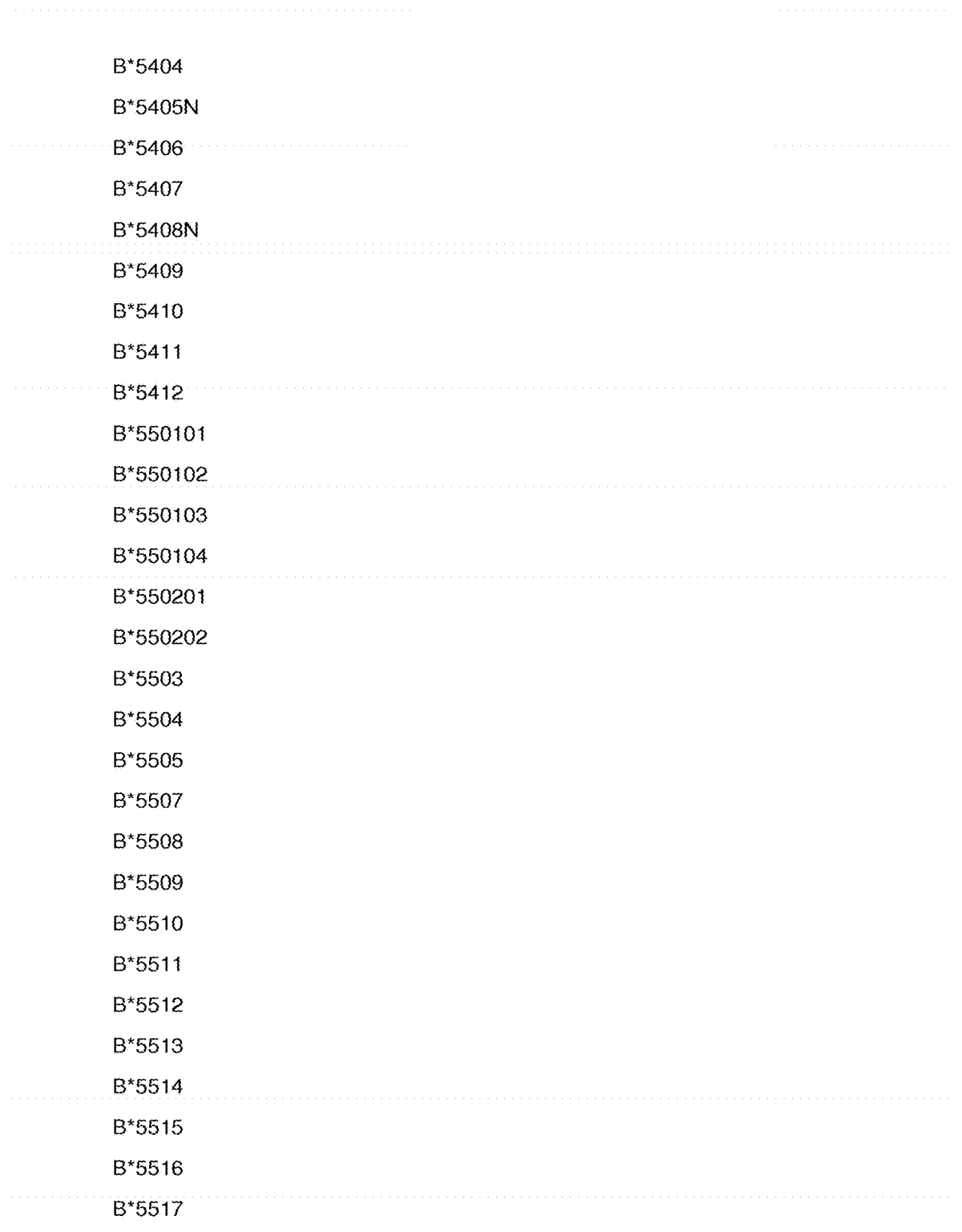

FIG. 1: List of HLA Class 1 alleles of particular interest of the present invention. From www.anthonynolan.org.uk/HIG/lists/classllist.html, 2007, FIG. 2: List of HLA Class 2 alleles of particular interest of the present invention. From h/a.alleles.org/alleles/class2.html, 2009.

FIG. 3:
(A) Immunization schedule used in rhesus macaques and challenge with SHIVSF162.P4 grown in C8166-CCR5$^+$ T cells (HLA-A*01, DRB1*04), (B) vaccine components in the 4 immunized groups and control, (C) dose and molecular ratio of the 4 constructs used to produce the 4 vaccines. Recombinant HLA class I proteins used: A*01, A*02, A*03, A*11, recombinant HLA class II: DRB1*04, HSP70$_{359-609}$. All components were biotinylated and linked to streptavidin-bound dextran (total 162 mg). Groups 1, 2 and 3 received full vaccine doses (SC) at the first immunization and half the dose in the $2^{nd}$, $3^{rd}$ and $4^{th}$ immunizations, with Titermax (0.5 ml). Group 5 animals received the same vaccine as group 2 but without Titermax and full vaccine doses at all 4 immunizations administered IM.

Figure 4:
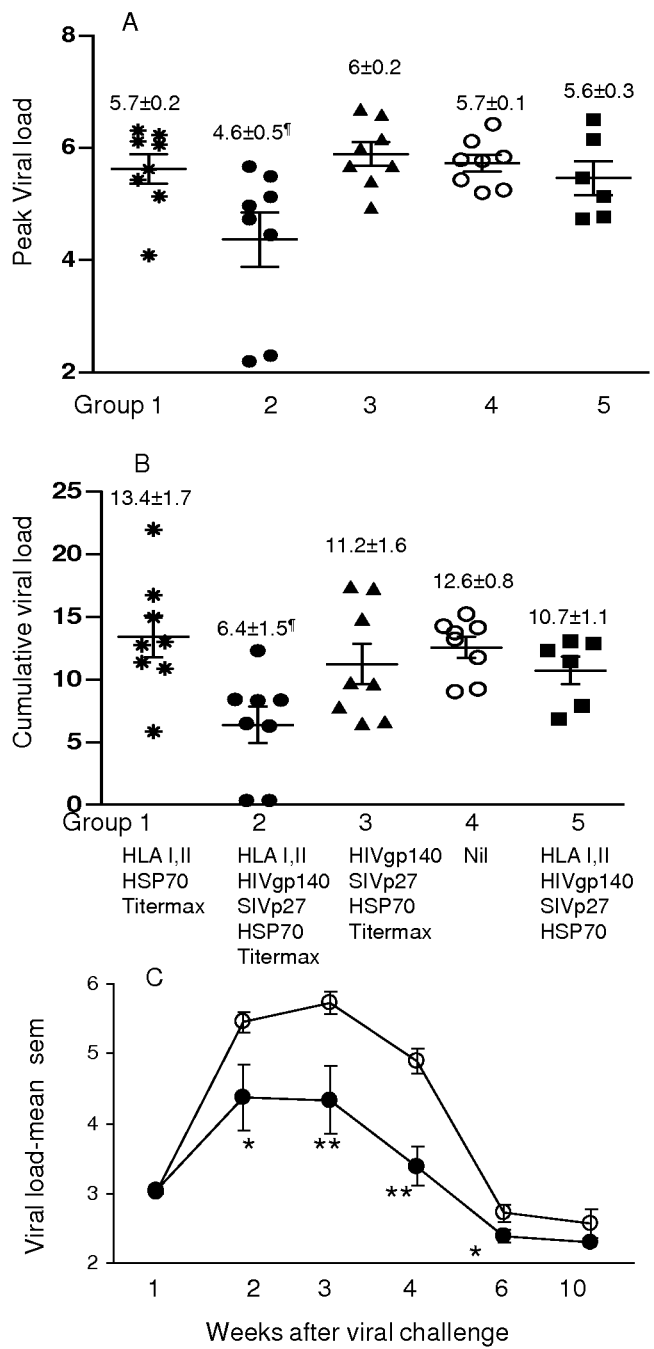

FIG. 4:
(A) Peak viral load (log 10), (B) Cumulative viral load (log 10) over 10 weeks (area under curve) for each animal in the 4 immunized (groups 1, 2, 3 and 5) and unimmunized (group 4), (C) Viral load of group 2 (•) compared with the unimmunized group 4(O) macaques (mean±sem); One-way Anova: (A) F=3.325, p=0.0054; (B) F=3.9745, p=0.0096, ¶ p<0.05 between group 2 and 4 in A and B. * p<0.05, ** p<0.01

Figure 5:
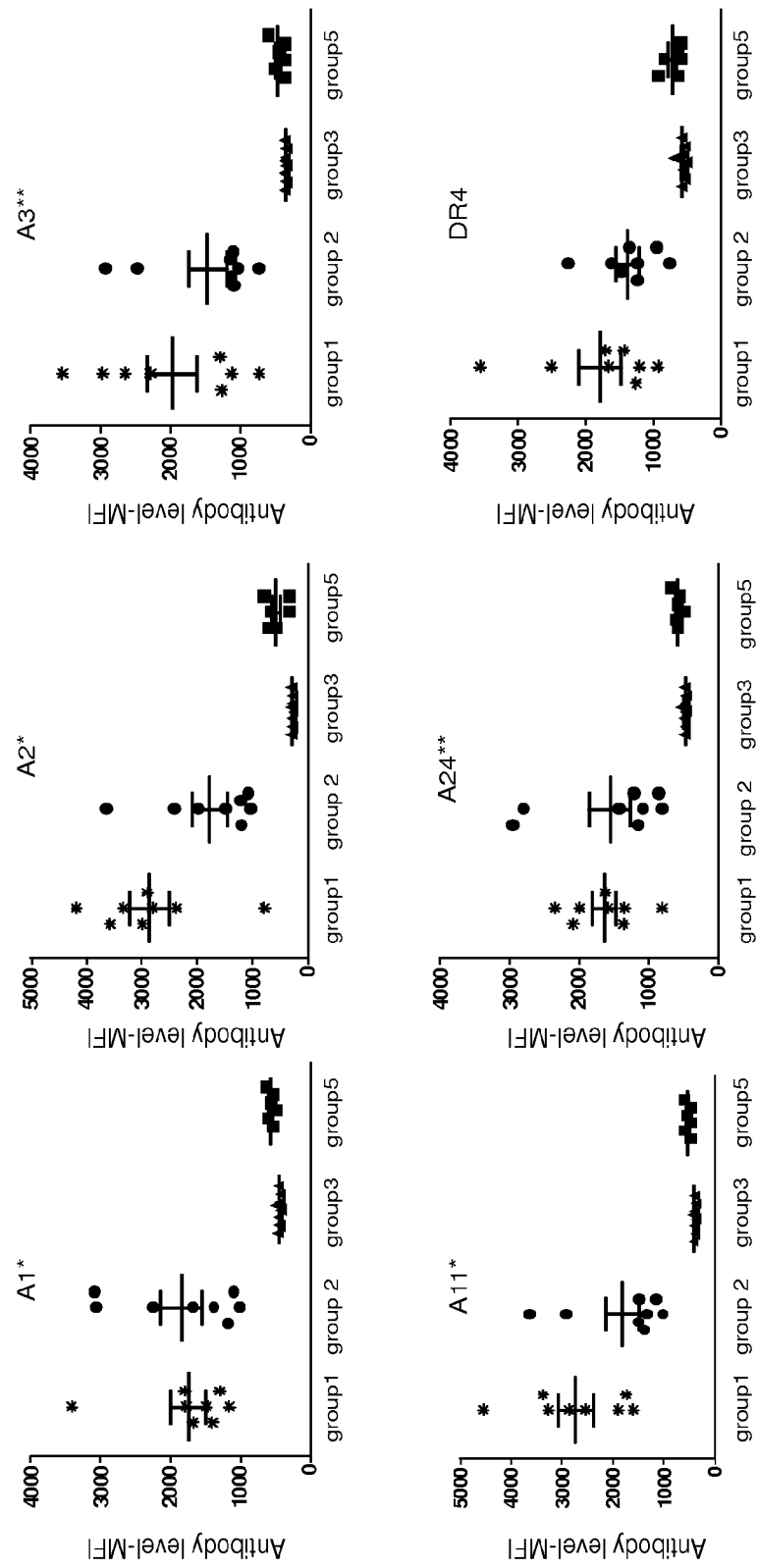

FIG. 5:
4 Effect of Immunization on induction of serum antibodies (1:1000 dilution) to HLA class I A1, A2, A3, A11, A24 and DR4 in 4 groups of macaques: group 1 (• HLA class I, II, HSP70 and Titermax), group 2 (O HLA class I, II, HIV gp140, SIV gp27, HSP70 and Titermax), group 3 (Ⓚ HIV gp140, SIV p27, HSP70 and Titermax) and group 5 (▲ HLA class I, II, HIVgp140, SIVp27 and HSP70. Cross-reactivity between: * A1, A2 and A11, ** A3 and A24

Figure 6:
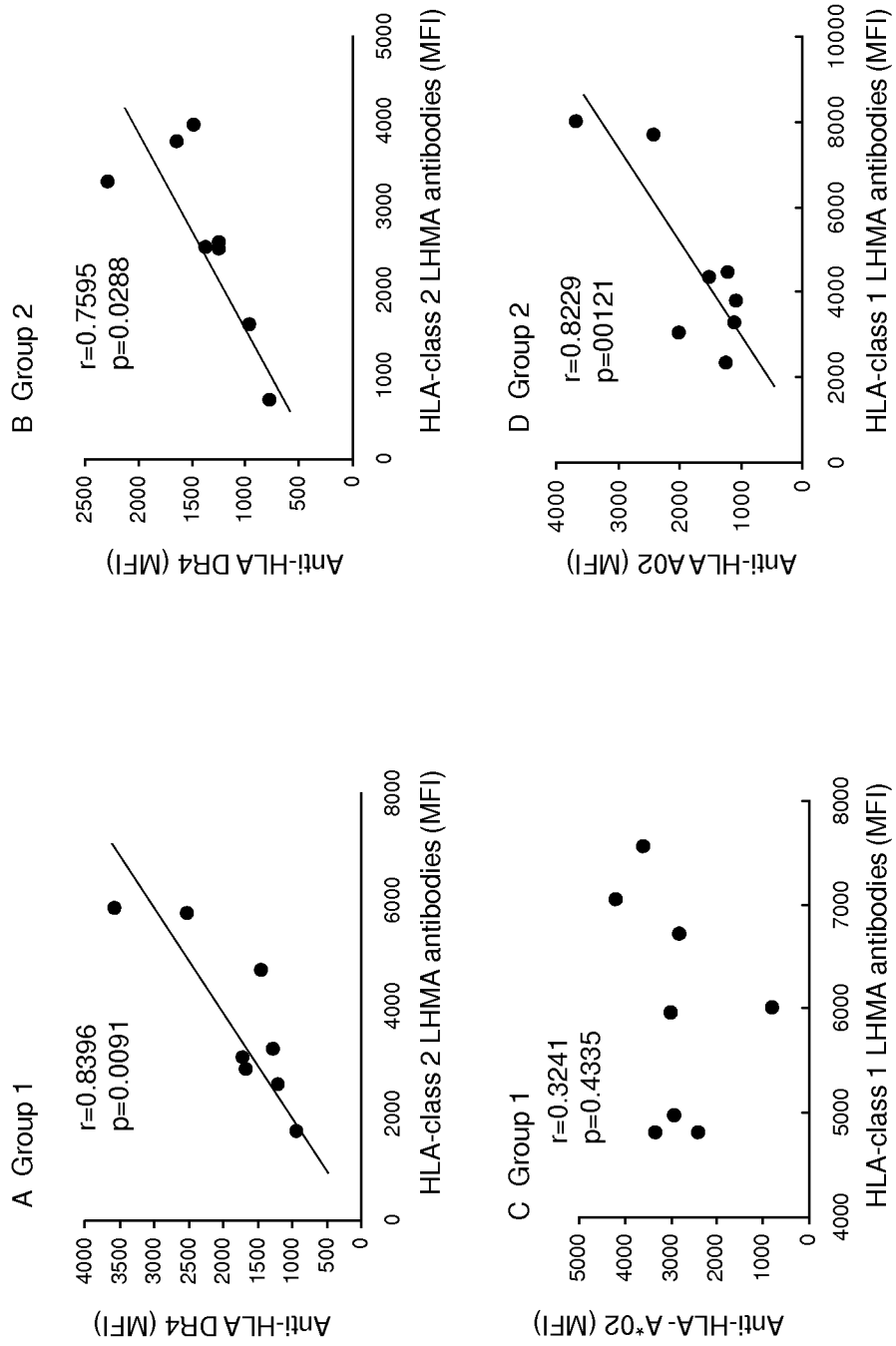
Figure 7:
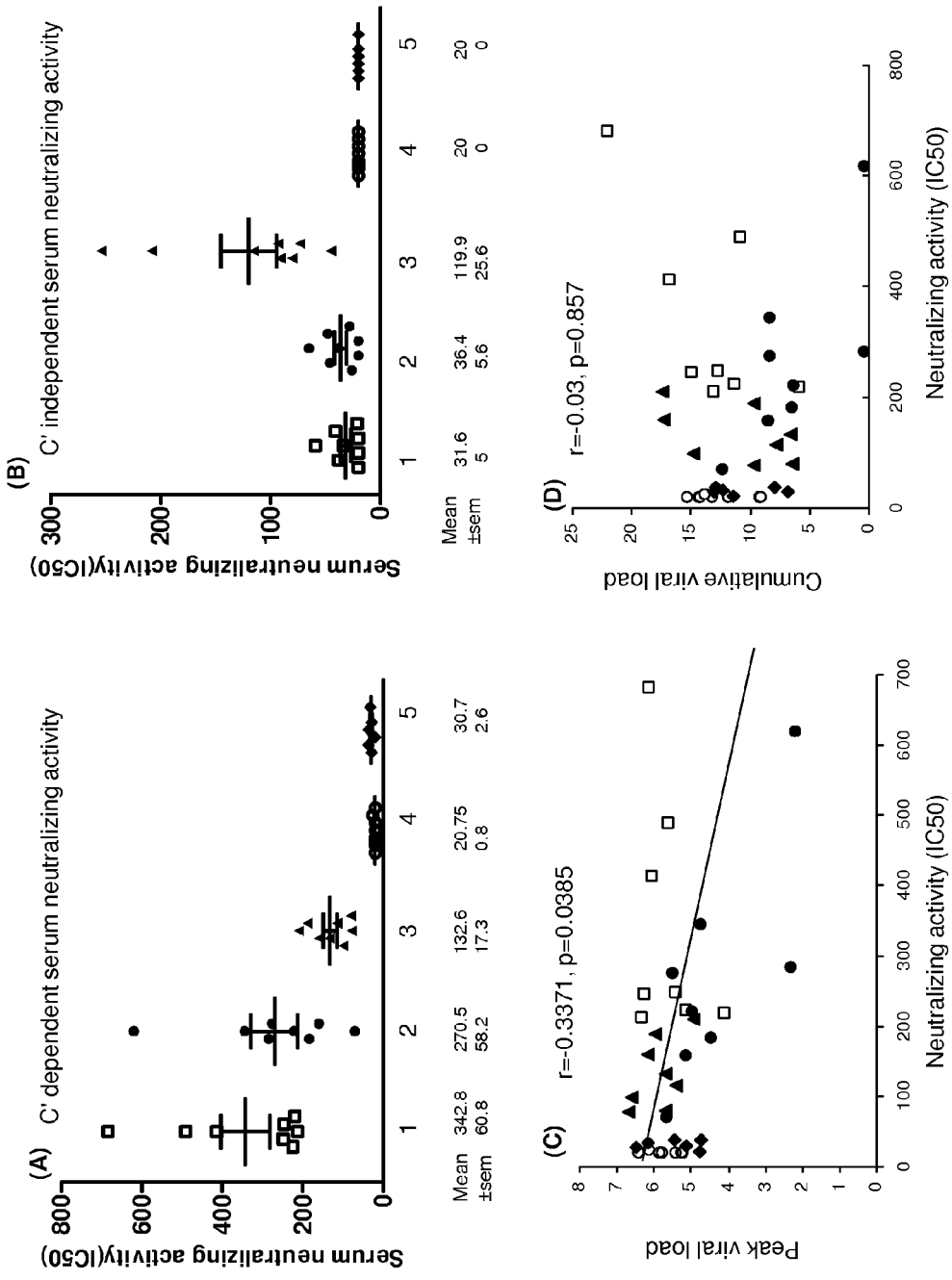

FIG. 6:
Correlation between the Luminex HLA multibead antibody (LHMA) assay for HLA-class 2 and class 1 and specific antibodies induced by immunization with HLA-DR4 and HLA-A*02, respectively FIG. 7:
Serum neutralizing activity (IC50) in the 5 groups of macaques after the last immunization. (A) Complement dependent, (B) Complement independent, (C) correlation with peak viral load, (D) correlation with cumulative loads; ☐ Group1, • Group2, ▲ Group3, O Group4, ♦ Group5

FIG. 8: Amino acid sequence of a monomer gp140 molecule comprising biotinylation tag and oligomerization domain enabling biotinylation and trimer formation respectively.

FIG. 9: Amino acid sequence of Siv p$^{27}$ encoded by the Gag gene of SIV.

FIG. 10: Examples of useful reactive groups comprised in multimerization domains and/or biologically active molecules of the present invention.

DETAILED DESCRIPTION OF THE INVENTION

The present invention relates to a composition comprising one or more pharmamers. Pharmamers are molecules or molecule complexes characterised by having one or more multimerisation domains whereto one or more biologically active molecules are attached either directly or through a linker. The biologically active molecules may also themselves comprise one or more multimerisation domains.

Other components may also be attached to the pharmamer in order to broaden, increase, decrease or otherwise modify the binding of and/or effect of the pharmamer.

In another embodiment the invention relates to compositions comprising one or more pharmamers and additionally comprises one or more adjuvant(s), one or more vaccine enhance(s) and/or one or more biologically active molecules not attached to the pharmamer construct. These other molecules may broaden, increase, decrease or otherwise modify the binding, effect or uptake of the pharmamer construct(s) or may have an effect themselves affecting the overall effect of the composition.

In one embodiment the present invention relates to methods for construction of pharmamers and for making compositions comprising one or more pharmamers.

In another embodiment the present invention relates to the use of compositions comprising one or more pharmamers for vaccination of an individual in need thereof. Compositions of pharmamers may be used for prophylactic vaccination of individuals to protect the individual against e.g. viral disease, bacterial disease, parasitic disease, cancer disease, autoimmune disease, allergy or other diseases.

Pharmamer compositions may also be used for therapeutic vaccination in order to cure, alleviate or prevent/delay progression of one or more diseases e.g. viral disease, bacterial disease, parasitic disease, cancer disease, autoimmune disease, allergy or other diseases.

In the following pharmamers and compositions comprising pharmamers are described in more detail.

Design, Generation and Use of Pharmamers

As used in the description of this invention, the term "pharmamers" will be used to describe any molecule or molecule complex where the number of involved molecules or molecule complexes is larger than one, and where these components are held together in a large complex by covalent or non-covalent interactions to the multimerization domain and/or between the individual components. The components can be identical or different molecules or molecular complexes.

Example, organic molecule-based pharmamers include functionalized cyclic structures such as benzene rings where e.g. a benzene ring is functionalized and covalently linked to e.g. three immunologically active molecules; example, cell-based pharmamers include dendritic cells and antigen presenting cells (APCs); example, membrane-based pharmamers include liposomes and micelles carrying immunologically active molecules or complexes in their membranes; example, polymer-based pharmamers include molecule constructs where immunologically active molecules or complexes are bound covalently or non-covalently to a dextran backbone/multimerisation domain and; example, particles include beads or other solid supports with immunologically active molecules immobilized on the surface. Obviously, any kind of multimerization domain can be used, including any kind of cell, polymer, protein or other molecular structure, or particles and solid supports.

Different approaches can be taken to attach or assemble the various components of a pharmamer, i.e. the biologically active molecules and the multimerization domain(s). This can be done by chemical reactions between reactive groups of the multimerization domain and reactive groups on a immunologically active protein, or by non-covalent interaction between a part of the immunologically active protein (e.g. a biotinylated peptide component) and the multimerization domain (e.g. four binding sites for biotin on the strepavidin tetrameric protein). As an alternative, the pharmamer can be formed by the non-covalent association of amino acid helices fused to one component of immunologically active protein, to form a pentameric pharmamer, held together by five helices in a coiled-coil structure making up the multimerization domain.

Appropriate chemical reactions for the covalent coupling of molecules or molecular complexes to the multimerization domain include nucleophilic substitution by activation of electrophiles (e.g. acylation such as amide formation, pyrazolone formation, isoxazolone formation; alkylation; vinylation; disulfide formation), addition to carbon-hetero multiple bonds (e.g. alkene formation by reaction of phosphonates with aldehydes or ketones; arylation; alkylation of arenes/hetarenes by reaction with alkyl boronates or enolethers), nucleophilic substitution using activation of nucleophiles (e.g. condensations; alkylation of aliphatic halides or tosylates with enolethers or enamines), and cycloadditions.

Appropriate molecules, capable of providing non covalent interactions between the multimerization domain and the immunologically and/or biologically active molecules or complexes hereof involve the following molecule pairs and molecules: streptavidin/biotin, avidin/biotin, antibody/antigen, DNA/DNA, DNA/PNA, DNA/RNA, PNA/PNA, LNA/DNA, leucine zipper e.g. Fos/Jun, IgG dimeric protein, IgM multivalent protein, acid/base coiled-coil helices, chelate/metal ion-bound chelate, streptavidin (SA) and avidin and derivatives thereof, biotin, immunoglobulins, antibodies (monoclonal, polyclonal, and recombinant), antibody fragments and derivatives thereof, leucine zipper domain of AP-1 (jun and fos), hexa-his (metal chelate moiety), hexa-hat GST (glutathione S-transferase) glutathione affinity, Calmodulin-binding peptide (CBP), Strep-tag, Cellulose Binding Domain, Maltose Binding Protein, S-Peptide Tag, Chitin Binding Tag, Immuno-reactive Epitopes, Epitope Tags, E2Tag, HA Epitope Tag, Myc Epitope, FLAG Epitope, AU1 and AU5 Epitopes, Glu-Glu Epitope, KT3 Epitope, IRS Epitope, Btag Epitope, Protein Kinase-C Epitope, VSV Epitope, lectins that mediate binding to a diversity of compounds, including carbohydrates, lipids and proteins, e.g. Con A (*Canavalia ensiformis*) or WGA (wheat germ agglutinin) and tetranectin or Protein A or G (antibody affinity). Combinations of such binding entities are also comprised. In particular, when the MHC complex is tagged, the binding entity can be an "anti-tag". By "anti-tag" is meant an antibody binding to the tag and any other molecule capable of binding to such tag.

In one embodiment the present invention relates to a vaccine composition comprising one or more pharmamers, wherein the one or more pharmamers has a molecular weight in the range 50,000 Da to 5,000,000 Da, such as from 50,000 Da to 100,000 Da, for example from 100,000 Da to 200,000 Da, such as from 200,000 Da to 300,000 Da, for example from 300,000 Da to 400,000 Da, such as from 400,000 Da to 500,000 Da, for example from 500,000 Da to 600,000 Da, such as from 600,000 Da to 700,000 Da, for example from 700,000 Da to 800,000 Da, such as from 800,000 Da to 900,000 Da, for example from 900,000 Da to 1,000,000 Da, such as from 1,000,000 Da to 1,200,000 Da, for example from 1,200,000 Da to 1,400,000 Da, such as from 1,400,000 Da to 1,600,000 Da, for example from 1,600,000 Da to 1,800,000 Da, such as from 1,800,000 Da to 2,000,000 Da, for example from 2,000,000 Da to 2,200,000 Da, such as from 2,200,000 Da to 2,400,000 Da, for example from 2,400,000 Da to 2,600,000 Da, such as from 2,600,000 Da to 2,800,000 Da, for example from 2,800,000 Da to 3,000,000 Da, such as from 3,000,000 Da to 3,200,000 Da, for example from 3,200,000 Da to 3,400,000 Da, such as from 3,400,000 Da to 3,600,000 Da, for example from 3,600,000 Da to 3,800,000 Da, such as from 3,800,000 Da to 4,000,000 Da, for example from 4,000,000 Da to 4,200,000 Da, such as from 4,200,000 Da to 4,400,000 Da, for example from 4,400,000 Da to 4,600,000 Da, such as from 4,600,000 Da to 4,800,000 Da, for example from 4,800,000 Da to 5,000,000 Da.

In another embodiment the present invention relates to a vaccine composition comprising one or more pharmamers, wherein the one or more pharmamers has an average molecular weight in the range 50,000 Da to 5,000,000 Da, such as from 50,000 Da to 4,000,000 Da; such as from 50,000 Da to 3,000,000 Da; such as from 50,000 Da to 2,000,000; such as from 50,000 Da and 1,000,000 Da, such as from 50,000 Da to 980,000; for example from 50,000 Da to 960,000; such as from 50,000 Da to 940,000; for example from 50,000 Da to 920,000; such as from 50,000 Da to 900,000; for example from 50,000 Da to 880,000; such as from 50,000 Da to 860,000; for example from 50,000 Da to 840,000; such as from 50,000 Da to 820,000; for example from 50,000 Da to 800,000; such as from 50,000 Da to 780,000; for example from 50,000 Da to 760,000; such as from 50,000 Da to 740,000; for example from 50,000 Da to 720,000; such as from 50,000 Da to 700,000; for example from 50,000 Da to 680,000; such as from 50,000 Da to 660,000; for example from 50,000 Da to 640,000; such as from 50,000 Da to 620,000; for example from 50,000 Da to 600,000; such as from 50,000 Da to 580,000; for example from 50,000 Da to 560,000; such as from 50,000 Da to 540,000; for example from 50,000 Da to 520,000; such as from 50,000 Da to 500,000; for example from 50,000 Da to 480,000; such as from 50,000 Da to 460,000; for example from 50,000 Da to 440,000; such as from 50,000 Da to 420,000; for example from 50,000 Da to 400,000; such as from 50,000 Da to 380,000; for example from 50,000 Da to 360,000; such as from 50,000 Da to 340,000; for example from 50,000 Da to 320,000; such as from 50,000 Da to 300,000; for example from 50,000 Da to 280,000; such as from 50,000 Da to 260,000; for example from 50,000 Da to 240,000; such as from 50,000 Da to 220,000; for example from 50,000 Da to 200,000; such as from 50,000 Da to 180,000; for example from 50,000 Da to 160,000; such as from 50,000 Da to 140,000; for example from 50,000 Da to 120,000; such as from 50,000 Da to 100,000; for example from 50,000 Da to 80,000; such as from 50,000 Da to 60,000; such as from 100,000 Da to 980,000; for example from 100,000 Da to 960,000; such as from 100,000 Da to 940,000; for example from 100,000 Da to 920,000; such as from 100,000 Da to 900,000; for example from 100,000 Da to 880,000; such as from 100,000 Da to 860,000; for example from 100,000 Da to 840,000; such as from 100,000 Da to 820,000; for example from 100,000 Da to 800,000; such as from 100,000 Da to 780,000; for example from 100,000 Da to 760,000; such as from 100,000 Da to 740,000; for example from 100,000 Da to 720,000; such as from 100,000 Da to 700,000; for example from 100,000 Da to 680,000; such as from 100,000 Da to 660,000; for example from 100,000 Da to 640,000; such as from 100,000 Da to 620,000; for example from 100,000 Da to 600,000; such as from 100,000 Da to 580,000; for example from 100,000 Da to 560,000; such as from 100,000 Da to 540,000; for example from 100,000 Da to 520,000; such as from 100,000 Da to 500,000; for example from 100,000 Da to 480,000; such as from 100,000 Da to 460,000; for example from 100,000 Da to 440,000; such as from 100,000 Da to 420,000; for example from 100,000 Da to 400,000; such as from 100,000 Da to 380,000; for example from 100,000 Da to 360,000; such as from 100,000 Da to 340,000; for example from 100,000 Da to 320,000; such as from 100,000 Da to 300,000; for example from 100,000 Da to 280,000; such as from 100,000 Da to 260,000; for example from 100,000 Da to 240,000; such as from 100,000 Da to 220,000; for example from 100,000 Da to 200,000; such as from 100,000 Da to 180,000; for example from 100,000 Da to 160,000; such as from 100,000 Da to 140,000; for example from 100,000 Da to 120,000; such as from 150,000 Da to 980,000; for example from 150,000 Da to 960,000; such as from 150,000 Da to 940,000; for example from 150,000 Da to 920,000; such as from 150,000 Da to 900,000; for example from 150,000 Da to 880,000; such as from 150,000 Da to 860,000; for example from 150,000 Da to 840,000; such as from 150,000 Da to 820,000; for example from 150,000 Da to 800,000; such as from 150,000 Da to 780,000; for example from 150,000 Da to 760,000; such as from 150,000 Da to 740,000; for example from 150,000 Da to 720,000; such as from 150,000 Da to 700,000; for example from 150,000 Da to 680,000; such as from 150,000 Da to 660,000; for example from 150,000 Da to 640,000; such as from 150,000 Da to 620,000; for example from 150,000 Da to 600,000; such as from 150,000 Da to 580,000; for example from 150,000 Da to 560,000; such as from 150,000 Da to 540,000; for example from 150,000 Da to 520,000; such as from 150,000 Da to 500,000; for example from 150,000 Da to 480,000; such as from 150,000 Da to 460,000; for example from 150,000 Da to 440,000; such as from 150,000 Da to 420,000; for example from 150,000 Da to 400,000; such as from 150,000 Da to 380,000; for example from 150,000 Da to 360,000; such as from 150,000 Da to 340,000; for example from 150,000 Da to 320,000; such as from 150,000 Da to 300,000; for example from 150,000 Da to 280,000; such as from 150,000 Da to 260,000; for example from 150,000 Da to 240,000; such as from 150,000 Da to 220,000; for example from 150,000 Da to 200,000; such as from 150,000 Da to 180,000; for example from 150,000 Da to 160,000.

The present invention further relates to a vaccine composition comprising one or more pharmamers, wherein the one or more pharmamers has an average molecular weight in the range 50,000 Da to 5,000,000 Da, such as from 50,000 Da to 100,000 Da, for example from 100,000 Da to 200,000 Da, such as from 200,000 Da to 300,000 Da, for example from 300,000 Da to 400,000 Da, such as from 400,000 Da to 500,000 Da, for example from 500,000 Da to 600,000 Da, such as from 600,000 Da to 700,000 Da, for example from 700,000 Da to 800,000 Da, such as from 800,000 Da to 900,000 Da, for example from 900,000 Da to 1,000,000 Da, such as from 1,000,000 Da to 1,200,000 Da, for example from 1,200,000 Da to 1,400,000 Da, such as from 1,400,000 Da to 1,600,000 Da, for example from 1,600,000 Da to 1,800,000 Da, such as from 1,800,000 Da to 2,000,000 Da, for example from 2,000,000 Da to 2,200,000 Da, such as from 2,200,000 Da to 2,400,000 Da, for example from 2,400,000 Da to 2,600,000 Da, such as from 2,600,000 Da to 2,800,000 Da, for example from 2,800,000 Da to 3,000,000 Da, such as from 3,000,000 Da to 3,200,000 Da, for example from 3,200,000 Da to 3,400,000 Da, such as from 3,400,000 Da to 3,600,000 Da, for example from 3,600,000 Da to 3,800,000 Da, such as from 3,800,000 Da to 4,000,000 Da, for example from 4,000,000 Da to 4,200,000 Da, such as from 4,200,000 Da to 4,400,000 Da, for example from 4,400,000 Da to 4,600,000 Da, such as from 4,600,000 Da to 4,800,000 Da, for example from 4,800,000 Da to 5,000,000 Da.

The present invention further relates to a vaccine composition comprising one or more pharmamers, wherein the one or more pharmamers has a molecular weight of at least 50,000 Da, such as at least 100,000 Da, for example at least 200,000 Da, such as at least 300,000 Da, for example at least 400,000 Da, such as at least 500,000 Da, for example at least 600,000 Da, such as at least 700,000 Da, for example at least 800,000 Da, such as at least 900,000 Da, for example at least 1,000,000 Da, such as at least 1,100,000 Da, for example at least 1,200,000 Da, such as at least 1,300,000 Da, for example at least 1,400,000 Da, such as at least 1,500,000 Da, for example at least 1,600,000 Da, such as at least 1,700,000 Da, for example at least 1,800,000 Da, such as at least 1,900,000 Da, for example at least 2,000,000 Da, such as at least 2,100,000 Da, for example at least 2,200,000 Da, such as at least 2,300,000 Da, for example at least 2,400,000 Da, such as at least 2,500,000 Da, for example at least 2,600,000 Da, such as at least 2,700,000 Da, for example at least 2,800,000 Da, such as at least 2,900,000 Da, for example at least 3,000,000 Da, such as at least 3,100,000 Da, for example at least 3,200,000 Da, such as at least 3,300,000 Da, for example at least 3,400,000 Da, such as at least 3,500,000 Da, for example at least 3,600,000 Da, such as at least 3,700,000 Da, for example at least 3,800,000 Da, such as at least 3,900,000 Da, for example at least 4,000,000 Da, such as at least 4,100,000 Da, for example at least 4,200,000 Da, such as at least 4,300,000 Da, for example at least 4,400,000 Da, such as at least 4,500,000 Da, for example at least 4,600,000 Da, such as at least 4,700,000 Da, for example at least 4,800,000 Da, such as at least 4,900,000 Da, for example at least 5,000,000 Da.

The present invention further relates to a vaccine composition comprising one or more pharmamers, wherein the one or more pharmamers has a molecular weight of less than 5,000,000 Da, such as less than 4,900,000 Da, for example less than 4,800,000 Da, such as less than 4,700,000 Da, for example less than 4,600,000 Da, such as less than 4,500,000 Da, for example less than 4,400,000 Da, such as less than 4,300,000 Da, for example less than 4,200,000 Da, such as less than 4,100,000 Da, for example less than 4,000,000 Da, such as less than 3,900,000 Da, for example less than 3,800,000 Da, such as less than 3,700,000 Da, for example less than 3,600,000 Da, such as less than 3,500,000 Da, for example less than 3,400,000 Da, such as less than 3,300,000 Da, for example less than 3,200,000 Da, such as less than 3,100,000 Da, for example less than 3,000,000 Da, such as less than 2,900,000 Da, for example less than 2,800,000 Da, such as less than 2,700,000 Da, for example less than 2,600,000 Da, such as less than 2,500,000 Da, for example less than 2,400,000 Da, such as less than 2,300,000 Da, for example less than 2,200,000 Da, such as less than 2,100,000 Da, for example less than 2,000,000 Da, such as less than 1,900,000 Da, for example less than 1,800,000 Da, such as less than 1,700,000 Da, for example less than 1,600,000 Da, such as less than 1,500,000 Da, for example less than 1,400,000 Da, such as less than 1,300,000 Da, for example less than 1,200,000 Da, such as less than 1,100,000 Da, for example less than 1,000,000 Da, such as less than 900,000 Da, for example less than 800,000 Da, such as less than 700,000 Da, for example less than 600,000 Da, such as less than 500,000 Da, for example less than 400,000 Da, such as less than 300,000 Da, for example less than 200,000 Da, such as less than 100,000 Da, for example less than 50,000 Da.

In one embodiment the present invention relates to a vaccine composition comprising more than 1 pharmamer, such as more than 2, 3, 4, 5, 6, 7, 8, 9, 10, 11, 12, 13, 14, 15, 16, 17, 18, 19, 20, 25, 30, 35, 40, 45, 50, 55, 60, 65, 70, 75, 80, 85, 90, 95, 100, 200, 300, 400, 500, 600, 700, 800, 900, 1,000, 2,000, 3,000, 4,000, 5,000, 6,000, 7,000, 8,000, 9,000, or more than 10,000 pharmamers.

In another embodiment the present invention relates to a vaccine composition comprising more than 2 different pharmamers, such as more than 3, 4, 5, 6, 7, 8, 9, 10, 11, 12, 13, 14, 15, 16, 17, 18, 19, 20, 25, 30, 35, 40, 45, 50, 55, 60, 65, 70, 75, 80, 85, 90, 95, 100, 200, 300, 400, 500, 600, 700, 800, 900, 1,000, 2,000, 3,000, 4,000, 5,000, 6,000, 7,000, 8,000, 9,000, or more than 10,000 different pharmamers.

In yet another embodiment the present invention relates to a vaccine composition comprising more than 2 identical pharmamers, such as more than 3, 4, 5, 6, 7, 8, 9, 10, 11, 12, 13, 14, 15, 16, 17, 18, 19, 20, 25, 30, 35, 40, 45, 50, 55, 60, 65, 70, 75, 80, 85, 90, 95, 100, 200, 300, 400, 500, 600, 700, 800, 900, 1,000, 2,000, 3,000, 4,000, 5,000, 6,000, 7,000, 8,000, 9,000, or more than 10,000 identical pharmamers.

In a further embodiment the present invention relates to a vaccine composition comprising less than 10,000 pharmamers, such as for example less than 9,000, 8,000, 7,000, 6,000, 5,000, 4,000, 3,000, 2,000, 1,000, 900, 800, 700, 600, 500, 400, 300, 200, 100, 95, 90, 85, 80, 75, 70, 65, 60, 55, 50, 45, 40, 35, 30, 25, 20, 15, 10, 9, 8, 7, 6, 5, 4, 3, or less than 2 pharmamers.

In a further embodiment the present invention relates to a vaccine composition comprising less than 10,000 different pharmamers, such as for example less than 9,000, 8,000, 7,000, 6,000, 5,000, 4,000, 3,000, 2,000, 1,000, 900, 800, 700, 600, 500, 400, 300, 200, 100, 95, 90, 85, 80, 75, 70, 65, 60, 55, 50, 45, 40, 35, 30, 25, 20, 15, 10, 9, 8, 7, 6, 5, 4, 3 or less than 2 different pharmamers.

In a further embodiment the present invention relates to a vaccine composition comprising less than 10,000 identical pharmamers, such as for example less than 9,000, 8,000, 7,000, 6,000, 5,000, 4,000, 3,000, 2,000, 1,000, 900, 800, 700, 600, 500, 400, 300, 200, 100, 95, 90, 85, 80, 75, 70, 65, 60, 55, 50, 45, 40, 35, 30, 25, 20, 15, 10, 9, 8, 7, 6, 5, 4, 3, or less than 2 identical pharmamers.

Multimerisation Domains

The pharmemers of the invention in one embodiment comprise one or more multimerization domain(s). The multimerization domain(s) can be a soluble multimerization domain(s) or a not soluble multimerization domain(s). The multimerization domain(s) can be any such which enables attachment of the MHC molecules, the binding entities, and/or the biologically active compounds, while providing advantageous properties of the construct.

Examples of suitable multimerization domain(s)s are polysaccharides including dextrans, carboxy methyl dextran, dextran polyaldehyde, carboxymethyl dextran lactone, and cyclodextrins, pullulans, schizophyllan, scleroglucan, xanthan, gellan, O-ethylamino guaran, chitins and chitosans indlucing 6-O-carboxymethyl chitin and N-carboxymethyl chitosan, derivatised cellolosics including carboxymethyl cellulose, carboxymethyl hydroxyethyl cellulose, hydroxyethyl cellulose, 6-amino-6-deoxy cellulose and O-ethylamine cellulose, hydroxylated starch, hydroxypropyl starch, hydroxyethyl starch, carrageenans, alginates, and agarose, synthetic polysaccharides including ficoll and carboxymethylated ficoll, vinyl polymers including poly (acrylic acid), poly (acryl amides), poly (acrylic esters), poly (2-hydroxy ethyl methacrylate), poly (methyl methacrylate), poly (maleic acid), poly (maleic anhydride), poly (acrylamide), poly (ethyl-co-vinyl acetate), poly (methacrylic acid), poly (vinyl-alcohol), poly (vinyl alcohol-co-vinyl chloroacetate), aminated poly (vinyl alcohol), and co block polymers thereof, poly ethylene glycol (PEG) or polypropylene glycol or poly (ethylene oxide-co-propylene oxides) comprising polymer backbones including linear, comb-shaped or Star-Burst dendrimers, poly amino acids including polylysines, polyglutamic acid, polyurethanes, poly (ethylene imines), pluriol, proteins including peptides, polypeptides, antigen-binding peptides, albumins, immunoglobulins, coiled-coil helixes e.g. Fos-Jun or Fos-Jun like or coiled-coiled dimers/trimers/tetramers/pentamers, Streptavidin, Avidin, Streptactin, T-cell receptors orther protein receptors and virus-like proteins (VLP), and polynucleotides, DNA, RNA, PNA, LNA, oligonucleotides and oligonucleotide dendrimer constructs and small organic molecules including but not limited to steroids, peptides, linear or cyclic structures, aromatic structures, aliphatic structures.

Also included are cells e.g. dendritic cells, antigen presenting cell, B-cell, T-cell Macrophages, Kupfer cells, Langerhans cells, transfected cells expressing biologically active proteins, including hybridoma cells, yeast-cells, insect-cells, CHO cells, any cell biologically active molecules, cell-like structures e.g. micelles, liposomes, and phages e.g. filamenteous phages and viral or viral-like particles.

Other suitable multimerization domains are solid supports including but not limited to beads, particulate matters and other surfaces.

Also included are self-assembling multimeric structures as described elsewhere herein.

Also included in this definition of the multimerization domain(s) is mixed forms, i.e. one or more multimerization domain(s) composed of one or more of the above examples. An example of this is dextran coupled with Streptavidin whereto biotinylated biologically active proteins can bind.

The choice of multimerization domain(s) depend i.e. on the application of the pharmamer. Of course, several parameters can be varied in the above-given examples of multimerization domain(s), including the length and branching. Furthermore, the multimerization domain(s) can carry various substitutions, including such, which can be protected and/or activated, enabling further derivatisation.

It is to be understood that the pharmamer construct of the invention can further comprise one or several different biologically active molecules in order to affect the characteristics of the constructs, e. g. with respect to binding properties, effects, antigenecity, specificity, solubility, stability, or detectability. For instance, spacing could be provided between the biologically active molecules.

One preferred embodiment of the present invention includes multimerisation domains made of Streptavidin or Avidin whereto biotin, biotin-like peptides or other biotin-like molecules can bind.

Another preferred embodiment includes dextran whereto biologically active molecules are attached directly through a linker as described elsewhere herein. The biologically active molecules can also be attached through a second multimerization domain or an entity as described elsewhere herein. Examples include but is not limited to divinylsulfone activated dextran whereto biologically active molecules are coupled directly e.g. through —SH group(s) or amine(s) in the biologically active molecules, dextran coupled with SA whereto biologically active molecules are attached through a biotin on the biologically active molecule, dextran with biologically active molecules are attached through a coiled-coil structure where on α-helix of a coiled-coil dimer is coupled to dextran and the other α-helix is coupled to the biologically active molecule e.g. as a fusion protein.

A preferred embodiment include beads or bead-like structures having an excluded volume (e.g. polysaccharide beads, polystyrene beads, magnetic polystyrene beads, polycarbamate beads, or any other kind of beads that can be dissolved or suspended in aqueous buffer) that carry electrophilic groups (e.g. divinyl sulfone activated polysaccharide, polystyrene beads that have been functionalized with tosyl-activated esters, magnetic polystyrene beads functionalized with tosyl-activated esters), and where biologically active molecules have been covalently immobilized to these by reaction of nucleophiles comprised within the biologically active molecule with the electrophiles of the beads.

In another preferred embodiment, the biologically active molecules described immediately above (where the one or more multimerization domain(s) is a bead) further comprises a flexible or rigid, and water soluble, linker that allows for the immobilized biologically active molecules to interact efficiently with surrounding cells and molecules. In another embodiment, the linker is cleavable, allowing for release of the biologically active molecules from the bead.

In another preferred embodiment the bead is covalently or non-covalently coated with pharmamers or single biologically active molecules, through non-cleavable or cleavable linkers. As an example, the bead can be coated with streptavidin monomers, which in turn are associated with biotinylated pharmamers; or the bead can be coated with streptavidin tetramers, each of which are associated with 0, 1, 2, 3, or 4 biotinylated biologically active molecules; or the bead can be coated with biologically active molecules where e.g. the reactive groups of the biologically active molecules (e.g. the divinyl sulfone-activated dextran backbone) has reacted with nucleophilic groups on the bead, to form a covalent linkage between the dextran of the dextramer and the beads.

A preferred embodiment including self-assembling multimeric structures are trimeric, tetrameric, pentameric, hexameric or heptameric coiled-coil structures holding together 3, 4, 5, 6 or 7 biologically active molecules. The coiled-coil structures may be attached to biologically active molecules through covalent or non-covalent bonds.

In some of the abovementioned embodiments, several multimerization domains (e.g. streptavidin tetramers bound to biotinylated biologically active molecules) are linked to another multimerization domain (e.g. the bead). For the purpose of the invention we shall call both the smaller and the bigger multimerization domain, as well as the combined multimerization domain, for multimerization domain.

In another preferred embodiment the one or more multimerization domain(s) can be any support capable of binding the biologically active molecules. Well-known supports or multimerization domains include glass, polystyrene, polypropylene, polyethylene, dextran, nylon, amylases, natural and modified celluloses, polyacrylamides, gabbros, and magnetite. The nature of the one or more multimerization domain(s) can be either soluble to some extent or insoluble for the purposes of the present invention. The support material can have virtually any possible structural configuration so long as the coupled molecule is capable of binding to the biologically active molecule. The support configuration can be spherical, as in a bead, or cylindrical, as in the inside surface of a test tube, or the external surface of a rod. Alternatively, the surface can be flat such as a sheet, test strip, a membrane, or a plastic surface.

In another preferred embodiment the multimerization domain(s) can be a polymer or an oligomer or a non-repeating moiety. The polymer or oligomer moiety can comprise repeat units consisting of a repeat moiety selected from alkyl (e.g., —$CH_2$—), substituted alkyl (e.g., —CHR—), alkenyl, substituted alkenyl, alkynyl, substituted alkynyl, phenyl, aryl, heterocyclic, amine, ether, sulfide, disulfide, hydrazine, and any of the foregoing substituted with oxygen, sulfur, sulfonyl, phosphonyl, hydroxyl, alkoxyl, amine, thiol, ether, carbonyl, carboxyl, ester, amide, alkyl, alkenyl, alkynyl, aryl, heterocyclic, as well as moieties comprising combinations thereof. Generally, a non-repeating multifunctional bridge moiety can be a moiety selected from alkyl, phenyl, aryl, alkenyl, alkynyl, heterocyclic, amine, ether, sulfide, disulfide, hydrazine, and any of the foregoing substituted with oxygen, sulfur, sulfonyl, phosphonyl, hydroxyl, alkoxyl, amine, thiol, ether, carbonyl, carboxyl, ester, amide, alkyl, alkenyl, alkynyl, aryl, heterocyclic, and moieties comprising combinations thereof (in each permutation). A non-repeating moiety can include repeating units (e.g., methylene) within portions or segments thereof without repeating as a whole.

The oligomer (or oligomer moiety) or the polymer (or polymer moiety), can generally be soluble or insoluble; can generally be a cross-linked oligomer (or oligomer moiety) or a cross-linked polymer (or polymer moiety); can generally be a homopolymer or a copolymer (including polymers having two monomer-repeat-units, terpolymers and higher-order polymers), including for example random copolymer moieties and block copolymer moieties; can generally include one or more ionic monomer moieties such as one or more anionic monomer moieties; can generally include one or more hydrophobic monomer moieties; can generally include one or more hydrophilic monomer moieties; and can generally include any of the foregoing features in combination.

The polymer moiety can be soluble or insoluble, existing for example as dispersed micelles or particles, such as colloidal particles or (insoluble) macroscopic beads. Polymer moieties can be hydrophobic, hydrophilic, amphiphilic, uncharged or non-ionic, negatively or positively charged, or a combination thereof, and can be organic or inorganic. Inorganic polymers, also referred to as inorganic multimerization domains in some cases, include silica (e.g., multi-layered silica), diatomaceous earth, zeolite, calcium carbonate, talc, and the like.

Suitable water-soluble polymers include polyethylene glycol (PEG), monomethoxy-PEG, mono-($C_1$-$C_{10}$)alkoxy-PEG, aryloxy-PEG, poly-(N-vinyl pyrrolidone)PEG, tresyl monomethoxy PEG, PEG propionaldehyde, bis-succinimidyl carbonate PEG, propylene glycol homopolymers, a polypropylene oxide/ethylene oxide co-polymer, polyoxyethylated polyols (e.g., glycerol), polyvinyl alcohol, dextran, cellulose, or other carbohydrate-based polymers. A conjugate can also comprise a mixture of such water-soluble polymers.

Examples of polysaccharides useful in the present invention include materials from vegetal or animal origin, including cellulose materials, hemicellulose, alkyl cellulose, hydroxyalkyl cellulose, carboxymethylcellulose, sulfoethylcellulose, starch, xylan, amylopectine, chondroitin, hyarulonate, heparin, guar, xanthan, mannan, galactomannan, chitin, and/or chitosan.

The type of multimerization domain can also be selected from, but is not limited to, the group consisting of agarose, sepharose, resin beads, glass beads, pore-glass beads, glass particles coated with a hydrophobic polymer, chitosan-coated beads, SH beads, latex beads, spherical latex beads, allele-type beads, SPA bead, PEG-based resins, PEG-coated bead, PEG-encapsulated bead, polystyrene beads, magnetic polystyrene beads, glutathione agarose beads, magnetic bead, paramagnetic beads, protein A and/or protein G sepharose beads, activated carboxylic acid bead, macroscopic beads, microscopic beads, insoluble resin beads, silica-based resins, cellulosic resins, cross-linked agarose beads, polystyrene beads, cross-linked polyacrylamide resins, beads with iron cores, metal beads, dynabeads, Polymethylmethacrylate beads activated with NHS, streptavidin-agarose beads, polypropylene, polyethylene, dextran, nylon, amylases, natural and modified celluloses, nitrocellulose, polyacrylamides, gabbros, magnetite, polymers, oligomers, non-repeating moieties, polyethylene glycol (PEG), monomethoxy-PEG, mono-($C_1$-$C_{10}$)alkoxy-PEG, aryloxy-PEG, poly-(N-vinyl pyrrolidone)PEG, tresyl monomethoxy PEG, PEG propionaldehyde, bis-succinimidyl carbonate PEG, polystyrene bead crosslinked with divinylbenzene, propylene glycol homopolymers, a polypropylene oxide/ethylene oxide co-polymer, polyoxyethylated polyols (e.g., glycerol), polyvinyl alcohol, dextran, aminodextran, carbohydrate-based polymers, cross-linked dextran beads, polysaccharide beads, polycarbamate beads, polyvinylcarbamate, divinyl sulfone activated polysaccharide, polystyrene beads that have been functionalized with tosyl-activated esters, magnetic polystyrene beads functionalized with tosyl-activated esters, streptavidin beads, streptavidin-monomer coated beads, streptavidin-tetramer coated beads, Streptavidin Coated Compel Magnetic beads, avidin coated beads, dextramer coated beads, divinyl sulfone-activated dextran, Carboxylate-modified bead, amine-modified beads, antibody coated beads, cellulose beads, grafted co-poly beads, poly-acrylamide beads, dimethylacrylamide beads optionally crosslinked with N—N'-bis-acryloylethylenediamine, hollow fiber membranes, fluorescent beads, collagen-agarose beads, gelatin beads, collagen-gelatin beads, collagen-fibronectin-gelatin beads, collagen beads, chitosan beads, collagen-chitosan beads, protein-based beads, hydrogel beads, hemicellulose, alkyl cellulose, hydroxyalkyl cellulose, carboxymethylcellulose, sulfoethylcellulose, starch, xylan, amylopectine, chondroitin, hyarulonate, heparin, guar, xanthan, mannan, galactomannan, chitin and chitosan.

In one embodiment the multimerization domain(s) in the present invention is preferable less than 1,000 Da (small molecule scaffold). In another embodiment the multimerization domain(s) is preferable between 1,000 Da and 10,000 Da (small molecule scaffold, small peptides, small polymers). In another embodiment the multimerization domain (s) is between 10,000 Da and 100,000 Da (Small molecule scaffold, polymers e.g. dextran, streptavidin, IgG, pentamer structure). In another embodiment the multimerization domain(s) is preferable between 100,000 Da and 1,000,000 Da (Small molecule scaffold, polymers e.g. dextran, streptavidin, IgG, pentamer structure). In another embodiment the multimerization domain(s) is preferable larger than 1,000,000 Da (Small molecule scaffold, polymers e.g. dextran, streptavidin, IgG, pentamer structure, cells, liposomes, artificial lipid bi layers, polystyrene beads and other beads.

The present invention relates in one embodiment to a vaccine composition comprising one or more pharmamers, wherein the one or more pharmamers comprises more than 1 multimerization domain such as more than 2, 3, 4, 5, 6, 7, 8, 9, 10, 11, 12, 13, 14, 15, 16, 17, 18, 19, 20, 25, 30, 35, 40, 45, 50, 55, 60, 65, 70, 75, 80, 85, 90, 95, 100, 200, 300, 400, 500, 600, 700, 800, 900, 1,000, 2,000, 3,000, 4,000, 5,000, 6,000, 7,000, 8,000, 9,000, or more than 10,000 multimerization domains.

The present invention relates in one embodiment to a vaccine composition comprising one or more pharmamers, wherein the one or more pharmamers comprises more than 1 different multimerization domain such as more than 2, 3, 4, 5, 6, 7, 8, 9, 10, 11, 12, 13, 14, 15, 16, 17, 18, 19, 20, 25, 30, 35, 40, 45, 50, 55, 60, 65, 70, 75, 80, 85, 90, 95, 100, 200, 300, 400, 500, 600, 700, 800, 900, 1,000, 2,000, 3,000, 4,000, 5,000, 6,000, 7,000, 8,000, 9,000, or more than 10,000 different multimerization domains.

The present invention relates in one embodiment to a vaccine composition comprising one or more pharmamers, wherein the one or more pharmamers comprises more than 1 identical multimerization domain such as more than 2, 3, 4, 5, 6, 7, 8, 9, 10, 11, 12, 13, 14, 15, 16, 17, 18, 19, 20, 25, 30, 35, 40, 45, 50, 55, 60, 65, 70, 75, 80, 85, 90, 95, 100, 200, 300, 400, 500, 600, 700, 800, 900, 1,000, 2,000, 3,000, 4,000, 5,000, 6,000, 7,000, 8,000, 9,000, or more than 10,000 identical multimerization domains.

The present invention relates in one embodiment to a vaccine composition comprising one or more pharmamers, wherein one or more pharmamers comprises less than 10,000 multimerization domains, such as for example less than 9,000, 8,000, 7,000, 6,000, 5,000, 4,000, 3,000, 2,000, 1,000, 900, 800, 700, 600, 500, 400, 300, 200, 100, 95, 90, 85, 80, 75, 70, 65, 60, 55, 50, 45, 40, 35, 30, 25, 20, 15, 10, 9, 8, 7, 6, 5, 4, 3, or less than 2 multimerization domains.

The present invention relates in one embodiment to a vaccine composition comprising one or more pharmamers, wherein one or more pharmamers comprises less than 10,000 different multimerization domains, such as for example less than 9,000, 8,000, 7,000, 6,000, 5,000, 4,000, 3,000, 2,000, 1,000, 900, 800, 700, 600, 500, 400, 300, 200, 100, 95, 90, 85, 80, 75, 70, 65, 60, 55, 50, 45, 40, 35, 30, 25, 20, 15, 10, 9, 8, 7, 6, 5, 4, 3, or less than 2 different multimerization domains.

The present invention relates in one embodiment to a vaccine composition comprising one or more pharmamers, wherein one or more pharmamers comprises less than 10,000 identical multimerization domains, such as for example less than 9,000, 8,000, 7,000, 6,000, 5,000, 4,000, 3,000, 2,000, 1,000, 900, 800, 700, 600, 500, 400, 300, 200, 100, 95, 90, 85, 80, 75, 70, 65, 60, 55, 50, 45, 40, 35, 30, 25, 20, 15, 10, 9, 8, 7, 6, 5, 4, 3, or less than 2 identical multimerization domains.

The present invention relates in one embodiment to a vaccine composition comprising one or more pharmamers, wherein the one or more multimerization domains(s) comprises one or more multimerization domain(s) with a molecular weight in the range 50,000 Da to 5,000,000 Da, such as from 50,000 Da to 100,000 Da, for example from 100,000 Da to 200,000 Da, such as from 200,000 Da to 300,000 Da, for example from 300,000 Da to 400,000 Da, such as from 400,000 Da to 500,000 Da, for example from 500,000 Da to 600,000 Da, such as from 600,000 Da to 700,000 Da, for example from 700,000 Da to 800,000 Da, such as from 800,000 Da to 900,000 Da, for example from 900,000 Da to 1,000,000 Da, such as from 1,000,000 Da to 1,200,000 Da, for example from 1,200,000 Da to 1,400,000 Da, such as from 1,400,000 Da to 1,600,000 Da, for example from 1,600,000 Da to 1,800,000 Da, such as from 1,800,000 Da to 2,000,000 Da, for example from 2,000,000 Da to 2,200,000 Da, such as from 2,200,000 Da to 2,400,000 Da, for example from 2,400,000 Da to 2,600,000 Da, such as from 2,600,000 Da to 2,800,000 Da, for example from 2,800,000 Da to 3,000,000 Da, such as from 3,000,000 Da to 3,200,000 Da, for example from 3,200,000 Da to 3,400,000 Da, such as from 3,400,000 Da to 3,600,000 Da, for example from 3,600,000 Da to 3,800,000 Da, such as from 3,800,000 Da to 4,000,000 Da, for example from 4,000,000 Da to 4,200,000 Da, such as from 4,200,000 Da to 4,400,000 Da, for example from 4,400,000 Da to 4,600,000 Da, such as from 4,600,000 Da to 4,800,000 Da, for example from 4,800,000 Da to 5,000,000 Da.

Biologically Active Molecules

Pharmamers consist of one or more biologically active molecules coupled to a multimerization domain, as defined above. The biologically active molecules can be selected among every known biologically active molecule on basis of their function in order to obtain the desired functionality of the pharmamer and the final vaccine. Biologically active molecules are molecules having biological activity. Biologically active molecules in a pharmamer affect the binding characteristics and/or the effects of the pharmamer.

Biologically active molecules of the present invention can be divided into the following categories:

Proteins. The proteins may be full length or truncated and may be modified e.g. by introduction of additional amino acids, mutated, chemically modified (e.g. acetylation, methylation, Pegylation, phosphorylation, glycosylation etc.) or carrying other modifications. The proteins may also be stabilized by covalent or non-covalent attachment of protein linkers or other protein molecules. Biologically active protein molecules of the present invention includes but is not limited to:

Enzymes

Receptor proteins or co-receptor proteins

Immunological proteins (se section below for more details)

Growth factors (proteins capable of stimulating cellular proliferation and differentiation)

Protein hormones

Proteins from microorganisms (viral, bacterial, parasitic, fungal ect.)

Surface proteins, including full length protein, truncated or otherwise modified proteins. Example surface protein include any protein on the surface of microorganism e.g. the envelope proteins gp41, gp120 or gp140 from HIV or truncated version of these. For vaccine composition purposes surface proteins may be made as recombinant proteins by cloning, expression and purification. Optionally the gene encoding the surface protein or a fragment of the protein may be fused to a gene encoding a protein tag for e.g. enzymatic biotinylation (e.g. comprising a recognition sequence for the BirA anzyme), chemically biotinylation (e.g. comprising an amino acid with a free —SH group), a multimerisation domain, one half of a coiled coil structure or another protein tag or protein fragment. An example of a protein that can be used in vaccine compositions of the present invention is recombinant gp140 may be made by cloning gp140 minus the transmembrane part of the protein leaving just the ecto domain of gp41 and gp120. These two molecules are held together through noncovalently association. An example of an amino acid sequence of such a recombinant gp140 protein is shown in FIG. 8 (SEQ ID NO 9583). Likewise gp120 may be produced recombinantly by cloning and expression.)

Intracellular and internal proteins. These are proteins inside cells proteins inside an organism e.g. inside envelop vira. For vaccine composition purposes such proteins may be made as recombinant proteins by cloning, expression and purification. Optionally the gene encoding the intracellular or internal protein or a fragment of the protein may be fused to a gene encoding a protein tag for e.g. enzymatic biotinylation (e.g. comprising a recognition sequence for the BirA anzyme), chemically biotinylation (e.g. comprising an amino acid with a free —SH group), a multimerisation domain, one half of a coiled coil structure or another protein tag or protein fragment Example internal protein includes p27 from HIV that is a protein encoded by the gag gene and is a structural protein of the viral core. An example of the protein sequence of GAG p$2^7$ is shown in FIG. 9 (SEQ ID NO 9584).

Secreted proteins (e.g. toxins)

Unmodified

Modified (e.g. toxoid)

Chemically modified

Physically modified

Nucleic acids

DNA

Encoding protein

Structural not encoding protein

RNA
    Ribosome's
    Antisense
    Silencing RNA (siRNA)
    MicroRNA
  LNA
  PNA
Carbohydrates
  Saccharides and derivatives thereof, e.g. phosphorylated, oxidized, reduced, amino derivatives, acetylated etc. Saccharides may have more than one modification
    Monosaccharide's
    Disaccharides
    Polysaccharides
      Homopolysaccharides (e.g. glycans, dextran)
      Polymers of repeating disaccharide units in which one of the sugars are is either N-acetylgalactosamine or N-acetylglucosamine (e.g. Glucosaminoglycans)
      Polysaccharide-peptide polymer (Peptidoglycan (bacterial cell wall))
      Proteins carrying covalent attached oligosaccharides or polysaccharides (Glycoprotein's)
      Lipids carrying covalent attached oligo- or polysaccharides (Glycolipids)
Lipids
  Fatty acyls (e.g. prostaglandins, leukotrienes etc.)
  Glycerolipids (e.g. triglycerides)
  Glycerophospholipids
  Sphingolipids
  Sterol lipids (eg. cholesterol, estrogen etc.)
  Prenol lipids (eg vitamin E, K)
  Polyketides (eg. erythromycin)
Small molecules. Small molecules are medicinal drug compounds having a molecular weights less than 1000 Daltons and include:
  Natural compounds including but not limited to
    Hormones
      Lipid and phospholipid derived hormones
        Steroids
        Eicosanoids
      Amine-derived hormones (derivatives of amino acids tyrosine and tryptophan (e.g. catecholamine, thyroxine)
    Salts, e.g. comprising Ca++, Mg++
  Synthetic chemical compound
    Benzodiazepines
    Short peptides
    Peptidommimetics
    Other chemical compounds In one embodiment the present invention relates to a vaccine composition comprising one or more pharmamers, wherein the one or more pharmamers comprises more than 1 biologically active molecules such as more than 2, 3, 4, 5, 6, 7, 8, 9, 10, 11, 12, 13, 14, 15, 16, 17, 18, 19, 20, 25, 30, 35, 40, 45, 50, 55, 60, 65, 70, 75, 80, 85, 90, 95, 100, 200, 300, 400, 500, 600, 700, 800, 900, 1,000, 2,000, 3,000, 4,000, 5,000, 6,000, 7,000, 8,000, 9,000, or more than 10,000 biological active molecules.

In another embodiment the present invention relates to a vaccine composition comprising one or more pharmamers, wherein the one or more pharmamers comprises more than 1 different biologically active molecules such as more than 2, 3, 4, 5, 6, 7, 8, 9, 10, 11, 12, 13, 14, 15, 16, 17, 18, 19, 20, 25, 30, 35, 40, 45, 50, 55, 60, 65, 70, 75, 80, 85, 90, 95, 100, 200, 300, 400, 500, 600, 700, 800, 900, 1,000, 2,000, 3,000, 4,000, 5,000, 6,000, 7,000, 8,000, 9,000, or more than 10,000 different biological active molecules.

In yet another embodiment the present invention relates to a vaccine composition comprising one or more pharmamers, wherein the one or more pharmamers comprises more than 1 identical biologically active molecules such as more than 2, 3, 4, 5, 6, 7, 8, 9, 10, 11, 12, 13, 14, 15, 16, 17, 18, 19, 20, 25, 30, 35, 40, 45, 50, 55, 60, 65, 70, 75, 80, 85, 90, 95, 100, 200, 300, 400, 500, 600, 700, 800, 900, 1,000, 2,000, 3,000, 4,000, 5,000, 6,000, 7,000, 8,000, 9,000, or more than 10,000 identical biological active molecules.

The present invention further relates to a vaccine composition comprising one or more pharmamers, wherein the one or more pharmamers comprises less than 10,000 biologically active molecules, such as for example less than 9,000, 8,000, 7,000, 6,000, 5,000, 4,000, 3,000, 2,000, 1,000, 900, 800, 700, 600, 500, 400, 300, 200, 100, 95, 90, 85, 80, 75, 70, 65, 60, 55, 50, 45, 40, 35, 30, 25, 20, 15, 10, 9, 8, 7, 6, 5, 4, 3, or less than 2 biologically active molecules.

The present invention further relates to a vaccine composition comprising one or more pharmamers, wherein the one or more pharmamers comprises less than 10,000 different biologically active molecules, such as for example less than 9,000, 8,000, 7,000, 6,000, 5,000, 4,000, 3,000, 2,000, 1,000, 900, 800, 700, 600, 500, 400, 300, 200, 100, 95, 90, 85, 80, 75, 70, 65, 60, 55, 50, 45, 40, 35, 30, 25, 20, 15, 10, 9, 8, 7, 6, 5, 4, 3 or less than 2 different biologically active molecules.

The present invention further relates to a vaccine composition comprising one or more pharmamers, wherein the one or more pharmamers comprises less than 10,000 identical biologically active molecules, such as for example less than 9,000, 8,000, 7,000, 6,000, 5,000, 4,000, 3,000, 2,000, 1,000, 900, 800, 700, 600, 500, 400, 300, 200, 100, 95, 90, 85, 80, 75, 70, 65, 60, 55, 50, 45, 40, 35, 30, 25, 20, 15, 10, 9, 8, 7, 6, 5, 4, 3, or less than 2 identical biologically active molecules.

The present invention further relates to a vaccine composition comprising more than 1 biologically active molecules such as more than 2, 3, 4, 5, 6, 7, 8, 9, 10, 11, 12, 13, 14, 15, 16, 17, 18, 19, 20, 25, 30, 35, 40, 45, 50, 55, 60, 65, 70, 75, 80, 85, 90, 95, 100, 200, 300, 400, 500, 600, 700, 800, 900, 1,000, 2,000, 3,000, 4,000, 5,000, 6,000, 7,000, 8,000, 9,000, or more than 10,000 biological active molecules.

The present invention further relates to a vaccine composition comprising more than 1 different biologically active molecules such as more than 2, 3, 4, 5, 6, 7, 8, 9, 10, 11, 12, 13, 14, 15, 16, 17, 18, 19, 20, 25, 30, 35, 40, 45, 50, 55, 60, 65, 70, 75, 80, 85, 90, 95, 100, 200, 300, 400, 500, 600, 700, 800, 900, 1,000, 2,000, 3,000, 4,000, 5,000, 6,000, 7,000, 8,000, 9,000, or more than 10,000 different biological active molecules.

The present invention further relates to a vaccine composition comprising more than 1 identical biologically active molecules such as more than 2, 3, 4, 5, 6, 7, 8, 9, 10, 11, 12, 13, 14, 15, 16, 17, 18, 19, 20, 25, 30, 35, 40, 45, 50, 55, 60, 65, 70, 75, 80, 85, 90, 95, 100, 200, 300, 400, 500, 600, 700, 800, 900, 1,000, 2,000, 3,000, 4,000, 5,000, 6,000, 7,000, 8,000, 9,000, or more than 10,000 identical biological active molecules.

In one embodiment the present invention relates to a vaccine composition, wherein the composition comprises less than 10,000 biologically active molecules, such as for example less than 9,000, 8,000, 7,000, 6,000, 5,000, 4,000, 3,000, 2,000, 1,000, 900, 800, 700, 600, 500, 400, 300, 200, 100, 95, 90, 85, 80, 75, 70, 65, 60, 55, 50, 45, 40, 35, 30, 25, 20, 15, 10, 9, 8, 7, 6, 5, 4, 3, or less than 2 biologically active molecules.

In one embodiment the present invention relates to a vaccine composition, wherein the composition comprises less than 10,000 different biologically active molecules, such as for example less than 9,000, 8,000, 7,000, 6,000, 5,000, 4,000, 3,000, 2,000, 1,000, 900, 800, 700, 600, 500, 400, 300, 200, 100, 95, 90, 85, 80, 75, 70, 65, 60, 55, 50, 45, 40, 35, 30, 25, 20, 15, 10, 9, 8, 7, 6, 5, 4, 3 or less than 2 different biologically active molecules.

In one embodiment the present invention relates to a vaccine composition, wherein the composition comprises less than 10,000 identical biologically active molecules, such as for example less than 9,000, 8,000, 7,000, 6,000, 5,000, 4,000, 3,000, 2,000, 1,000, 900, 800, 700, 600, 500, 400, 300, 200, 100, 95, 90, 85, 80, 75, 70, 65, 60, 55, 50, 45, 40, 35, 30, 25, 20, 15, 10, 9, 8, 7, 6, 5, 4, 3, or less than 2 biologically active molecules.

In one embodiment the invention relates to a vaccine composition comprising one or more pharmamers and one or more biologically active molecules, wherein the one or more biologically active molecules are not attached to said one or more pharmamers.

In one embodiment the invention relates to a vaccine composition comprising one or more pharmamers and one or more biologically active molecules, wherein the one or more biologically active molecules are attached to some but not all of the one or more pharmamers.

In one embodiment the invention relates to a vaccine composition comprising one or more pharmamers and one or more biologically active molecules, wherein the one or more biologically active molecules are attached to one of the one or more pharmamers.

In one embodiment the invention relates to a vaccine composition comprising one or more pharmamers and one or more biologically active molecules, wherein the one or more biologically active molecules are attached to more than one of the one or more pharmamers such as more to than 2, 3, 4, 5, 6, 7, 8, 9, 10, 11, 12, 13, 14, 15, 16, 17, 18, 19, 20, 25, 30, 35, 40, 45, 50, 55, 60, 65, 70, 75, 80, 85, 90, 95, 100, 200, 300, 400, 500, 600, 700, 800, 900, 1,000, 2,000, 3,000, 4,000, 5,000, 6,000, 7,000, 8,000, 9,000, or to more than 10,000 of the one or more pharmamers.

In one embodiment the invention relates to a vaccine composition comprising one or more pharmamers and one or more biologically active molecules, wherein the one or more biologically active molecules are attached to less than 10,000 of the one or more pharmamers, such as for example to less than 9,000, 8,000, 7,000, 6,000, 5,000, 4,000, 3,000, 2,000, 1,000, 900, 800, 700, 600, 500, 400, 300, 200, 100, 95, 90, 85, 80, 75, 70, 65, 60, 55, 50, 45, 40, 35, 30, 25, 20, 15, 10, 9, 8, 7, 6, 5, 4, 3 or to less than 2 of the one or more pharmamers.

In one embodiment the present invention relates to a vaccine composition, wherein the one or more biologically active molecules and the one or more multimerization domain are coupled together either directly or indirectly.

Immunologically Active Molecules

In many applications, it will be advantageous that the pharmamer comprises one or more Immunologically active molecules. Immunologically active molecules are compounds that can modulate the immuno-activity of the pharmamer itself or the immune system as such, by affecting binding characteristics or effects of the pharmamer. A pharmamer can comprise several immunologically active molecules which can be the same or different.

Immunologically active molecules are a subgroup of biologically active molecules for example proteins, co-stimulatory molecules, cell modulating molecules, receptors, accessory molecules, adhesion molecules, natural ligands, and toxic molecules, antibodies, MHC molecules, TCR's and recombinant binding molecules to any of the foregoing, and combinations thereof.

Immunologically active molecules of special interest for the present invention can be selected from the groups listed below:

MHC class 1 proteins including HLA-A, HLA-B, HLA-C alleles. Examples of useful MHC 1 alleles are listed in FIG. 1. MHC class proteins useful as immunologically active molecules may be complete trimer molecule complexes or parts of MHC class 1 molecules as follows:
Heavy chains
Heavy chains combined with beta2microglobulin
Heavy chains combined with beta2microglobulin and antigenic peptide
Heavy chain combined with antigenic peptide
Beta2mcroglobulin MHC class 1-like molecules:
MICA, MICB
CD1d
HLA-E, HLA-F, HLA-G, HLA-H
ULBP-1, ULBP-2, ULBP-3

MHC 2 proteins including HLA-DR (HLA-DRA, HLA-DRB1, HLA-DRB3, HLA-DRB4, HLA-DRB5), HLA-DQ (HLA-DQA1, HLADQA2, HLA-DQB1, HLA-DQB2), HLA-DP (HLA-DPA1, HLA-DPB1), HLA-DO (HLA-DOA, HLA-DOB), HLA-DM (HLA-DMA, HLA-DMB). Examples of useful MHC 2 alleles are listed in FIG. 2. MHC class proteins useful as immunologically active molecules may be complete trimer molecule complexes or parts of MHC class 2 molecules as follows:
1 α-heavy chain
1 β-heavy chain
1 α-heavy chain+1 β-heavy chain
1 α-heavy chain+1 β-heavy chain+antigenic peptide
Fragments of α-heavy chain or β-heavy chain (MHC II-like peptides). MHC II-like proteins of special interest of the present invention are DRB3*02*03 like peptide: RFLELLKSECHFFNG (SEQ ID NO 9585), DRB4*-like peptide RVWNLIRYIYNQEEY (SEQ ID NO 9586), DRB5*-like peptide FLQQD-KYECHFFNG (SEQ ID NO 9587).

Cytokines including:
Interferons such as IFN-alpha, IFN-beta, IFN-gamma
Interleukines such as IL-1, IL-2, IL-3, IL-4, IL-6, IL-7, IL-8, IL-10, IL-11, IL-12, IL-15, IL-16, IL-17, IL-18, IL-19, IL-20, IL-21, IL-22, IL-23, IL-24, IL-25, IL-26, IL-27, IL-28, -IL-29, IL-30, IL-31, IL-32, IL-33, IL-34, IL-35
Tumor necrosis factors: TNF-alfa, TNF-beta
Others: CSFs (colony-stimulating factors), c-Kit, EPO, TGF-β, CD40L, CD27L, CD30L, MIF Cytokine receptors like IL-1R, IL-2R, IL-3R, IL-4R, IL-5R, IL-6R, IL-7R, IL-8R, IL-9-R, IL-10R, IL-11R, IL-12R, IL-13R, IL-15R, IL-18R, IL-20R, IL-21R, IL-22R, IL-23R, IL-27R, IL-28R Chemokines such as CXCL1, CXCL2, CXCL3, CXCL4, CXCL5, CXCL6, CXCL7, CXCL8, CXCL9, CXCL10, CXCL11, CXCL12, CXCL13, CXCL14, CXCL15, CXCL16, CCL1, CCL2, CCL3, CCL4, CCL5, CCL6, CCL7, CCL8, CCL8, CCL9, CCL10, CCL11, CCL12, CCL13, CCL14, CCL15, CCL16, CCL17, CCL18, CCL19, CCL20, CCL21, CCL22, CCL23, CCL24, CCL25, CCL26, CCL27, CCL28, CXCR4, CCRL2

Chemokine receptors like CCR1, CCR2, CCR3, CCR4, CCR5, CCR6, CCR7, CCR8, CCR9, CCR10, CCR11, CXCR1, CXCR2, CXCR3, CXCR4, CXCR5, CXCR6, CXCR7, CX3CR1

Toll-like receptors such as TLR1, TLR2, TLR3, TLR4, TLR5, TLR6, TLR7, TLR8, TLR9, TLR10

Toll like receptor ligands such as multiple triacyl lipopeptides, multiple diacyl lipopeptides, multiple glycolipids, multiple lipopeptides, multiple lipoproteins, lipoteichoic acid, peptidoglycans, Zymosan, single- and double-stranded RNA, Poly I:C, lipo-polysaccharides, fibrinogen, heparin sulphate fragments, hyaluronic acid fragments, flagellin, imidazoquinoline, loxoribine (guanosine analogue), bropirimine, Imiquimod, unmethylated CpG DNA; Viral entry receptors/molecules such as Ku70, Pvr, Prr1, HVEM, EphrinB2, cellular integrins (in particular alpha2beta1, alpha6beta1 alphaVbeta3), CD81, CD155, SR-B1, claudin-1, xCT, human nectin-2, LIGHT, TLR3, LIR, Heparan sulphate proteoglycans, GPI anchored proteins, hemeagglutinin receptor Heat shock proteins such as HSP70, HSP90. The heat shock proteins may be full length, truncated and or modified and may originate from any organism (e.g. bacteria, parasites, humans, animals ect.). An embodiment of special interest of the present invention is the C-terminal part of HSP70 from Myciobacteria tuberculosis, e.g. amino acid 359-609. For vaccine composition purposes the C-terminal part of HSP70 may be mad as a recombinant protein by cloning, expression and purification. Optionally the gene encoding this C-terminal fragment may be fused to a gene encoding a protein tag for e.g. enzymatic biotinylation (e.g. comprising a recognition sequence for the BirA anzyme), chemically biotinylation (e.g. comprising an amino acid with a free —SH group), a multimerisation domain, one half of a coiled coil structure or another protein tag or protein fragment. An example of an amino acid sequence of a recombinant C-terminal fragment of HSP70 from is given below:

```
                                        (SEQ ID NO 9582)
LLQDFFNGRELNKSINPDEAVAYGAAVQAAILMGDTSGNVQDLLLLDV

APLSLGIETAGGVMTALIKRNTTIPTKQTQTFTTYSDNQPGVLIQVFEGE

RAMTKDNNLLGKFELTGIPPAPRGVPQIEVTFDIDANGILNVSAADKSTG

KQNKITITNDKGRLSKEEIERMVQEADMYKAEDDLQREKISAKNSLESYA

FNMKSSVEDDNLKGKISEEDKKRVIEKCNEAVSWLENNQLADKEEYEHQ

LKELEKVCNPVI
```

In another embodiment of the present invention C-terminal fragments of HSP70 from bacteria that are not Myciobacterium Tuberculosis or C-terminal HSP70 fragment's from other organism may be used as biologically active molecule.

In yet another embodiment

Bacterial entry receptors/molecules like CD48, CEACAM-1, -2, -3, -4, -5, -6, invasion, internalin (InlA), InlB Fc receptors like ε (FcεRI, FcεRII)—γ (FcγRI, FcγRII, FcγRIII)—α/µ (FcαRI, Fcα/µR)—Neonatal FcR Lymphocyte homing receptors such as CD44, L-selectin, VLA-4 (CD49a, b, c, d, e, f), LFA-1

Co-stimulatory molecules such as CD2, CD3, CD4, CD5, CD8, CD9, CD27, CD28, CD30, CD69, CD134 (OX40), CD120, CD137 (4-1BB), CD147, CDw150 (SLAM), CD152 (CTLA-4), CD153 (CD30L), CD40L (CD154), NKG2D, ICOS, PD-1, Fas (CD95), FasL, CD40, CD58, CD70, CD72, B7.1 (CD80), B7.2 (CD86), B7RP-1, B7-H3, PD-L1, PD-L2, CD134L, CD137L, ICOSL NK cell receptors/molecules such as CD16, NKp30, NKp44, NKp46, NKp80, 2B4, KIR3DL1, KIR3DL", KIR3DS1, KIR2DL1, KIRDL2, KIR2DL3, KIR2DL4, KIR2DL5, CD94/NKG2A, CD94/NKG2C, CD94/NKG2E, CD94/NKG2H, NKG2ADNKG2D Adhesion molecules such as ICAM-1, ICAM-2, GlyCAM-1, VCAM, CD34

Anti microbial peptides such Defensins and cathelicidin derived peptide LL-37

Antibodies (monoclonal, polyclonal, recombinant) directed to a defined antigen e.g. any of the described biologically active molecules, immunologically active molecules, viral antigens, bacterial antigens, parasitic antigens, self-antigens, cancer antigens or any other antigen. Antibodies of the present invention may be full length or derivatives of antibodies including:

Full length antibody

Fab fragments scFv fragments antibody-like structures e.g. scaffold proteins having the ability to bind antigens Toxic molecules selected e.g. toxins, toxids Enzymes Other molecules such as anti-LFA-1, anti-CD44, anti-beta7, anti-selectin L, anti-selectin E, and anti-selectin P, chemiluminescent substances, bioluminescent substances, polymers, metal particles, and haptens, such as cyclophosphamide, methrotrexate, Azathioprine, mizoribine, 15-deoxuspergualin, neomycin, staurosporine, genestein, herbimycin A, *Pseudomonas* exotoxin A, saporin, Rituxan, Ricin, gemtuzumab ozogamicin, Shiga toxin, vitamin D3, IL-2 toxins, cyclosporin, FK-506, rapamycin, TGF-beta, clotrimazole, nitrendipine, and charybdotoxin, heavy' metals like inorganic and organic mercurials, and FN18-CRM9, radioisotopes such as incorporated isotopes of iodide, cobalt, selenium, tritium, and phosphor, and haptens such as DNP, and digoxiginin A pharmamer composition may have one or more than one immunologically active molecule.

The immunologically active molecule can suitably be attached to the multimerization domain(s) either directly, through one or more linkers or via one or more of the binding entities or one or more multimerization domains as described elsewhere herein. The immunologically active molecules can also be linked to another immunologically active molecule and then attached to one or more multimerization domains.

MHC Monomer/Multimers and Antigenic Peptides

The present invention in one aspect refers to a vaccine composition comprising one or more MHC monomer comprising a-b-P, or a MHC multimer comprising (a-b-P)$_n$, wherein n>1, wherein a and b together form a functional MHC protein capable of binding the antigenic peptide P, wherein (a-b-P) is the MHC-peptide complex formed when the antigenic peptide P binds to the functional MHC protein, and wherein each MHC peptide complex of a MHC multimer is associated with one or more multimerization domains.

In the following the antigenic peptide P is used interchangeably with antigenic peptide.

Another aspect of the present invention refers to a vaccine composition comprising one or more antigenic peptides not bound to a MHC molecule or an antigenic polypeptide featuring one or more antigenic peptides.

MHC monomers and MHC multimers comprising one or more MHC peptide complexes of class 1 or class 2 MHC are covered by the present invention. In another embodiment the present invention covers antigenic peptides able to bind MHC class 1 and/or MHC class 2 molecules or antigenic polypeptides featuring such antigenic peptides. Accordingly, the antigenic peptide of the present invention can have a length of e.g. 8, 9, 10, 11, 12, 13, 14, 15, 16, 16-20, or 20-30 amino acid residues.

There is also provided a MHC multimer comprising 2 or more MHC-peptide complexes and a multimerization domain to which the 2 or more MHC-peptide complexes are associated. The MHC multimer can generally be formed by association of the 2 or more MHC-peptide complexes with the multimerization domain to which the 2 or more MHC-peptide complexes are capable of associating.

The multimerization domain can be a scaffold associated with one or more MHC-peptide complexes, or a carrier associated with one or more, preferably more than one, MHC-peptide complex(es), or a carrier associated with a plurality of scaffolds each associated with one or more MHC-peptide complexes, such as 2 MHC-peptide complexes, 3 MHC-peptide complexes, 4 MHC-peptide complexes, 5 MHC-peptide complexes or more than 5 MHC-peptide complexes. Accordingly, multimerization domain collectively refers to each and every of the above. It will be clear from the detailed description of the invention provided herein below when the multimerization domain refers to a scaffold or a carrier or a carrier comprising one or more scaffolds.

Generally, when a multimerization domain comprising a carrier and/or a scaffold is present, the MHC complexes can be associated with this domain either directly or via one or more binding entities. The association can be covalent or non-covalent.

Accordingly, there is provided in one embodiment a MHC complex comprising one or more entities $(a\text{-}b\text{-}P)_n$, wherein a and b together form a functional MHC protein capable of binding a antigenic peptide P, and wherein (a-b-P) is the MHC-peptide complex formed when the antigenic peptide P binds to the functional MHC protein, said MHC complex optionally further comprising a multimerization domain comprising a carrier molecule and/or a scaffold. "MHC complex" refers to any MHC complex, including MHC monomers in the form of a single MHC-peptide complex and MHC multimers comprising a multimerization domain to which more than one MHC peptide complex is associated.

When the invention is directed to a vaccine composition comprising a MHC multimer, i.e. a plurality of MHC peptide complexes of the general composition $(a\text{-}b\text{-}P)_n$ associated with a multimerization domain, n is by definition more than 1, i.e. at least 2 or more. Accordingly, the term "MHC multimer" is used herein specifically to indicate that more than one MHC-peptide complex is associated with a multimerization domain, such as a scaffold or carrier or carrier comprising one or more scaffolds. Accordingly, a single MHC-peptide complex can be associated with a scaffold or a carrier or a carrier comprising a scaffold and a MHC-multimer comprising 2 or more MHC-peptide complexes can be formed by association of the individual MHC-peptide complexes with a scaffold or a carrier or a carrier comprising one or more scaffolds each associated with one or more MHC-peptide complexes.

When the MHC complex comprises a multimerization domain to which the n MHC-peptide complexes are associated, the association can be a covalent linkage so that each or at least some of the n MHC-peptide complexes is covalently linked to the multimerization domain, or the association can be a non-covalent association so that each or at least some of the n MHC-peptide complexes are non-covalently associated with the multimerization domain.

The MHC complexes of the invention may be provided in non-soluble or soluble form, depending on the intended application.

Effective methods to produce a variety of MHC complexes comprising highly polymorphic human HLA encoded proteins makes it possible to perform advanced analyses of complex immune responses, which may comprise a variety of peptide epitope specific T-cell clones.

One of the benefits of the MHC complexes of the present invention is that the MHC complexes overcome low intrinsic affinities of monomer ligands and counter receptors. The MHC complexes have a large variety of applications that include targeting of high affinity receptors (e.g. hormone peptide receptors for insulin) on target cells. Taken together poly-ligand binding to target cells has numerous practical, clinical and scientifically uses.

Thus, the present invention provides MHC complexes which present mono-valent or multi-valent binding sites for MHC recognising cells, such as MHC complexes optionally comprising a multimerization domain, such as a scaffold or a carrier molecule, which multimerization domain have attached thereto, directly or indirectly via one or more linkers, covalently or non-covalently, one or more MHC peptide complexes. "One or more" as used herein is intended to include one as well as a plurality, such as at least 2. This applies i.a. to the MHC peptide complexes and to the binding entities of the multimerization domain. The scaffold or carrier molecule may thus have attached thereto a MHC peptide complex or a plurality of such MHC peptide complexes, and/or a linker or a plurality of linkers.

In one preferred embodiment the present invention relates to pharmamers or a vaccine composition comprising one or more pharmamers, wherein said phamamers comprise one or more identical or different antigenic peptides, fragments thereof or larger antigenic peptides/proteins comprising one or more of the sequences disclosed in this application.

An antigenic peptide is any peptide molecule that is bound to or able to bind into the binding groove of either MHC class 1 or MHC class 2.

The antigenic peptides may be directly attached to a multimerisation domain of a pharmamer using principles as described for other biologically active molecules elsewhere herein, they may be part of a larger protein or they may be bound to the peptide binding groove of MHC molecules and the MHC-peptide complex then attached to the multimerisation domain of the pharmamer.

The antigenic peptide(s) can e.g. be 8 mers, 9 mers, 10 mers, 11 mers, 12 mers, 13 mers, 14 mers, 15 mers or 16 mers.

The antigenic peptides can in one embodiment be any antigenic peptide e.g. peptide(s) predicted by the netMHC algorithm (www.cbs.dtu.dk/services/NetMHC/).

In one embodiment the peptide(s) are derived from Lentivirus proteins such as HIV (Human immunodeficiency virus) proteins, like HIV-1 proteins or HIV-2 proteins.

In another embodiment the peptides are derived from retrovirus proteins such as SIV (Simian immunodeficiency virus) proteins.

In yet another embodiment the antigenic peptide(s) are derived from a cancer antigen.

In one embodiment the antigenic peptide(s) are derived from one or more of the HIV-1 proteins NP_057849/Gag-Pol, NP_057850/Pr55(Gag), NP_057851/Vif, NP_057852/Vpr, NP_057853/Tat, NP_057854/Rev, NP_057855/Vpu, NP_057856/Envelope surface glycoprotein gp160 precursor and NP_057857/Nef or any variant or fragment thereof.

In one embodiment the antigenic peptide(s) include one or more HIV-1 peptides from the table below (SEQ ID NO 1-9568) or any variant or fragment thereof such as antigenic peptides comprising the core sequences listed in the table below or variants thereof.

HIV-1 peptides derived from the HIV-1 proteins predicted by the netMHC algorithm (www.cbs.dtu.dk/services/NetMHC/) are listed in the table herein below.

| Protein accession no/name | Antigenic peptides | SEQ ID NO |
|---|---|---|
| NP_057849 Gag-Pol | 8-mers:<br>MGARASVL; SVLSGGEL; ELDRWEKI; RWEKIRLR; RLRPGGKK; KLK HIVWA; IVWASREL; WASRELER; RELERFAV; FAVNPGLL; SEGCRQ IL; QLQPSLQT; LQTGSEEL; QTGSEELR; SLYNTVAT; LYNTVATL; YN TVATLY; TVATLYCV; TLYCVHQR; LYCVHQRI; DTKEALDK; KIEEEQ NK; DTGHSNQV; QVSQNYPI; NYPIVQNI; YPIVQNIQ; GQMVHQAI; SP RTLNAW; RTLNAWVK; TLNAWVKV; WVKVVEEK; KVVEEKAF; EKAF SPEV; FSPEVIPM; SPEVIPMF; EVIPMFSA; VIPMFSAL; IPMFSALS; F SALSEGA; ALSEGATP; TPQDLNTM; NTVGGHQA; TVGGHQAA; HQA AMQML; QAAMQMLK; MQMLKETI; ETINEEAA; EEAAEWDR; EAAEW DRV; EWDRVHPV; HPVHAGPI; GPIAPGQM; WMTNNPPI; TNNPPIPV; PPIPVGEI; PIPVGEIY; GEIYKRWI; EIYKRWII; IYKRWIIL; KRWIILGL; WIILGLNK; IILGLNKI; ILGLNKIV; LGLNKIVR; GLNKIVRM; IVRMYSPT; RMYSPTSI; MYSPTSIL; SPTSILDI; RQGPKEPF; DYVDRFYK; YVDRF YKT; DRFYKTLR; AEQASQEV; EQASQEVK; ASQEVKNW; EVKNWM TE; NWMTETLL; WMTETLLV; ETLLVQNA; NPDCKTIL; ILKALGPA; AL GPAATL; TLEEMMTA; EEMMTACQ; MMTACQGV; GVGGPGHK; VLA EAMSQ; AEAMSQVT; SQVTNSAT; VTNSATIM; SATIMMQR; IMMQR GNF; MMQRGNFR; RGNFRNQR; RNQRKIVK; HTARNCRA; RNCRAP RK; NCRAPRKK; APRKKGCW; QMKDCTER; CTERQANF; TERQANF L; ERQANFLR; RQANFLRE; FLREDLAF; DLAFLQGK; AFLQGKAR; FL QGKARE; LQGKAREF; REFSSEQT; EFSSEQTR; FSSEQTRA; QTRA NSPT; RANSPTRR; GADRQGTV; TVSFNFPQ; VSFNFPQV; FNFPQV TL; NFPQVTLW; TLWQRPLV; WQRPLVTI; RPLVTIKI; GQLKEALL; TG ADDTVL; TVLEEMSL; EEMSLPGR; MSLPGRWK; SLPGRWKP; KPK MIGGI; GIGGFIKV; RQYDQILI; EICGHKAI; HKAIGTVL; KAIGTVLV; VL VGPTPV; GPTPVNII; TPVNIIGR; NIIGRNLL; NLLTQIGC; LNFPISPI; F PISPIET; PISPIETV; SPIETVPV; IETVPVKL; ETVPVKLK; VPVKLPG; KVKQWPLT; KQWPLTEE; WPLTEEKI; TEEKIKAL; EEKIKALV; KIKAL VEI; LVEICTEM; EICTEMEK; KIGPENPY; ENPYNTPV; NPYNTPVF; Y NTPVFAI; NTPVFAIK; TPVFAIKK; PVFAIKKK; STKWRKLV; KWRKLV DF; KLVDFREL; DFRELNKR; RTQDFWEV; QLGIPHPA; GIPHPAGL; I PHPAGLK; GLKKKKSV; VLDVGDAY; VGDAYFSV; DAYFSVPL; SVPL DEDF; PLDEDFRK; DFRKYTAF; RKYTAFTI; YTAFTIPS; TAFTIPSI; IP SINNET; NETPGIRY; ETPGIRYQ; TPGIRYQY; GIRYQYNV; IRYQYNV L; YQYNVLPQ; NVLPQGWK; IFQSSMTK; FQSSMTKI; MTKILEPF; TKI LEPFR; KILEPFRK; KQNPDIVI; DIVIYQYM; IYQYMDDL; YQYMDDLY; QYMDDLYV; YMDDLYVG; DLYVGSDL; YVGSDLEI; DLEIGQHR; EIG QHRTK; RTKIEELR; IEELRQHL; EELRQHLL; ELRQHLLR; HLLRWGL T; LLRWGLTT; KEPPFLWM; PPFLWMGY; FLWMGYEL; GYELHPDK; YELHPDKW; ELHPDKWT; LHPDKWTV; WTVQPIVL; WTVNDIQK; TV NDIQKL; IQKLVGKL; KLVGKLNW; KLNWASQI; SQIYPGIK; QIYPGIK V; IYPGIKVR; KVRQLCKL; RQLCKLLR; KLLRGTKA; LLRGTKAL; GTK ALTEV; ALTEVIPL; EVIPLTEE; PLTEEAEL; TEEAELEL; EEAELELA; E LELAENR; ELAENREI; REILKEPV; KEPVHGVY; EPVHGVYY; GVYYD PSK; YYDPSKDL; DLIAEIQK; AEIQKQGQ; KQGQGQWT; GQGQWTY Q; GQWTYQIY; YQIYQEPF; QIYQEPFK; YQEPFKNL; NLKTGKYA; KT GKYARM; TGKYARMR; RMRGAHTN; HTNDVKQL; QLTEAVQK; KITT ESIV; TTESIVIW; ESIVIWGK; VIWGKTPK; IWGKTPKF; TPKFKLPI; KF KLPIQK; LPIQKETW; IQKETWET; KETWETWW; ETWETWWT; WET WWTEY; ETWWTEYW; TEYWQATW; EYWQATWI; WQATWIPE; QAT WIPEW; TWIPEWEF; WIPEWEFV; FVNTPPLV; NTPPLVKL; TPPLVKL W; PPLVKLWY; PLVKLWYQ; LVKLWYQL; KLWYQLEK; YQLEKEPI; Q LEKEPIV; EPIVGAET; IVGAETFY; VGAETFYV; ETFYVDGA; YVDGAA NR; GAANRETK; KLGKAGYV; KAGYVTNR; GYVTNRGR; VTNRGRQ K; GRQKVVTL; TLTDTTNQ; LTDTTNQK; TTNQKTEL; KTELQAIY; TEL QAIYL; ELQAIYLA; LQAIYLAL; LQDSGLEV; SGLEVNIV; NIVTDSQY; I VTDSQYA; VTDSQYAL; SQYALGII; YALGIIQA; ALGIIQAQ; SELVNQII; NQIIEQLI; QIIEQLIK; IIEQLIKK; QLIKKEKV; LIKKEKVY; KEKVYLAW; EKVYLAWV; YLAWVPAH; LAWVPAHK; WVPAHKGI; GIGGNEQV; QV DKLVSA; KLVSAGIR; LVSAGIRK; GIRKVLFL; KVLFLDGI; LFLDGIDK; FLDGIDKA; KAQDEHEK; EKYHSNWR; YHSNWRAM; AMASDFNL; NL | 1-3715 |

-continued

| Protein accession no/ name | Antigenic peptides | SEQ ID NO |
|---|---|---|
| | PPVVAK; PPVVAKEI; PVVAKEIV; EIVASCDK; CQLKGEAM; GEAMH | |
| | GQV; AMHGQVDC; QVDCSPGI; CSPGIWQL; WQLDCTHL; HLEGKVI | |
| | L; VILVAVHV; ILVAVHVA; AVHVASGY; GYIEAEVI; AEVIPAET; AETG | |
| | QETA; ETGQETAY; GQETAYFL; QETAYFLL; ETAYFLLK; FLLKLAGR; | |
| | KLAGRWPV; LAGRWPVK; GRWPVKTI; WPVKTIHT; HTDNGSNF; NF | |
| | TGATVR; FTGATVRA; TGATVRAA; ATVRAACW; AACWWAGI; WAGI | |
| | KQEF; GIKQEFGI; KQEFGIPY; NPQSQGVV; SQGVVESM; GVVESM | |
| | NK; VESMNKEL; ESMNKELK; SMNKELKK; AEHLKTAV; KTAVQMAV; | |
| | TAVQMAVF; VQMAVFIH; MAVFIHNF; AVFIHNFK; VFIHNFKR; FIHNF | |
| | KRK; YSAGERIV; RIVDIIAT; IATDIQTK; IQTKELQK; LQKQITKI; QITKI | |
| | QNF; ITKIQNFR; TKIQNFRV; KIQNFRVY; IQNFRVYY; QNFRVYYR; R | |
| | VYYRDSR; YRDSRNPL; NPLWKGPA; KGPAKLLW; LLWKGEGA; VIQ | |
| | DNSDI; DIKVVPRR; VVPRRKAK; VPRRKAKI; RRKAKIIR; KIIRDYGK; | |
| | KQMAGDDC; QMAGDDCV | |
| | 9-mers: | |
| | VLSGGELDR; LSGGELDRW; DRWEKIRLR; KIRLRPGGK; RLRPGGK | |
| | KK; GGKKKYKLK; KKYKLKHIV; KYKLKHIVW; KLKHIVWAS; HIVWAS | |
| | REL; WASRELERF; ERFAVNPGL; RFAVNPGLL; AVNPGLLET; GLLE | |
| | TSEGC; ETSEGCRQI; ILGQLQPSL; GQLQPSLQT; SLQTGSEEL; LQT | |
| | GSEELR; GSEELRSLY; ELRSLYNTV; SLYNTVATL; LYNTVATLY; NT | |
| | VATLYCV; ATLYCVHQR; TLYCVHQRI; YCVHQRIEI; CVHQRIEIK; QR | |
| | IEIKDTK; EIKDTKEAL; ALDKIEEEQ; QQAAADTGH; HSNQVSQNY; N | |
| | QVSQNYPI; QVSQNYPIV; QNYPIVQNI; VQNIQGQMV; IQGQMVHQA; | |
| | MVHQAISPR; HQAISPRTL; AISPRTLNA; ISPRTLNAW; SPRTLNAW | |
| | V; RTLNAWVKV; TLNAWVKVV; AWVKVVEEK; EEKAFSPEV; EKAFS | |
| | PEVI; FSPEVIPMF; EVIPMFSAL; IPMFSALSE; ALSEGATPQ; SEGAT | |
| | PQDL; ATPQDLNTM; TPQDLNTML; DLNTMLNTV; NTVGGHQAA; TV | |
| | GGHQAAM; HQAAMQMLK; AMQMLKETI; ETINEEAAE; TINEEAAEW; | |
| | EEAAEWDRV; EAAEWDRVH; AEWDRVHPV; RVHPVHAGP; HPVHA | |
| | GPIA; DIAGTTSTL; TTSTLQEQI; STLQEQIGW; TLQEQIGWM; GWMT | |
| | NNPPI; MTNNPPIPV; NPPIPVGEI; PPIPVGEIY; IPVGEIYKR; GEIYKR | |
| | WII; EIYKRWIIL; YKRWIILGL; RWIILGLNK; WIILGLNKI; IILGLNKIV; GL | |
| | NKIVRMY; KIVRMYSPT; IVRMYSPTS; RMYSPTSIL; SPTSILDIR; SIL | |
| | DIRQGP; ILDIRQGPK; RQGPKEPFR; EPFRDYVDR; PFRDYVDRF; R | |
| | DYVDRFYK; DYVDRFYKT; YVDRFYKTL; VDRFYKTLR; RAEQASQE | |
| | V; QASQEVKNW; EVKNWMTET; NWMTETLLV; WMTETLLVQ; VQNA | |
| | NPDCK; TILKALGPA; ILKALGPAA; KALGPAATL; GPAATLEEM; ATLE | |
| | EMMTA; TLEEMMTAC; EEMMTACQG; EMMTACQGV; GVGGPGHK | |
| | A; GGPGHKARV; GPGHKARVL; KARVLAEAM; VLAEAMSQV; LAEAM | |
| | SQVT; AEAMSQVTN; AMSQVTNSA; SQVTNSATI; QVTNSATIM; VTN | |
| | SATIMM; NSATIMMQR; IMMQRGNFR; MMQRGNFRN; RGNFRNQR | |
| | K; FRNQRKIVK; NQRKIVKCF; IVKCFNCGK; EGHTARNCR; TARNCR | |
| | APR; ARNCRAPRK; RNCRAPRKK; APRKKGCWK; HQMKDCTER; TE | |
| | RQANFLR; NFLREDLAF; FLREDLAFL; LAFLQGKAR; FLQGKAREF; K | |
| | AREFSSEQ; REFSSEQTR; QTRANSPTR; SPTRRELQV; PTRRELQV | |
| | W; RRELQVWGR; ADRQGTVSF; RQGTVSFNF; TVSFNFPQV; FNFP | |
| | QVTLW; FPQVTLWQR; VTLWQRPLV; TLWQRPLVT; LWQRPLVTI; W | |
| | QRPLVTIK; TIKIGGQLK; QLKEALLDT; DTVLEEMSL; EEMSLPGRW; | |
| | EMSLPGRWK; SLPGRWKPK; LPGRWKPKM; KMIGGIGGF; MIGGIG | |
| | GFI; GGIGGFIKV; KVRQYDQIL; RQYDQILIE; QYDQILIEI; ILIEICGHK; | |
| | IEICGHKAI; HKAIGTVLV; TVLVGPTPV; LVGPTPVNI; LLTQIGCTL; TQ | |
| | IGCTLNF; TLNFPISPI; FPISPIETV; SPIETVPVK; VPVKLKPGM; GMD | |
| | GPKVKQ; GPKVKQWPL; KQWPLTEEK; QWPLTEEKI; PLTEEKIKA; L | |
| | TEEKIKAL; ALVEICTEM; CTEMEKEGK; PENPYNTPV; NPYNTPVFA; | |
| | PYNTPVFAI; YNTPVFAIK; NTPVFAIKK; TPVFAIKKK; FAIKKKDST; AI | |
| | KKKDSTK; KWRKLVDFR; KLVDFRELN; LVDFRELNK; ELNKRTQDF; | |
| | KRTQDFWEV; RTQDFWEVQ; TQDFWEVQL; DFWEVQLGI; WEVQL | |
| | GIPH; VQLGIPHPA; LGIPHPAGL; GIPHPAGLK; IPHPAGLKK; TVLDV | |
| | GDAY; VLDVGDAYF; DVGDAYFSV; FSVPLDEDF; SVPLDEDFR; EDF | |
| | RKYTAF; DFRKYTAFT; YTAFTIPSI; FTIPSINNE; TIPSINNET; SINNET | |
| | PGI; ETPGIRYQY; YQYNVLPQG; QYNVLPQGW; VLPQGWKGS; QG | |
| | WKGSPAI; GWKGSPAIF; SPAIFQSSM; AIFQSSMTK; IFQSSMTKI; F | |
| | QSSMTKIL; SMTKILEPF; MTKILEPFR; KQNPDIVIY; NPDIVIYQY; VIY | |
| | QYMDDL; IYQYMDDLY; YQYMDDLYV; YMDDLYVGS; LYVGSDLEI; D | |
| | LEIGQHRT; HRTKIEELR; KIEELRQHL; IEELRQHLL; ELRQHLLRW; R | |
| | QHLLRWGL; HLLRWGLTT; LLRWGLTTP; RWGLTTPDK; TTPDKKH | |
| | QK; EPPFLWMGY; PFLWMGYEL; FLWMGYELH; MGYELHPDK; GYE | |
| | LHPDKW; YELHPDKWT; ELHPDKWTV; KWTVQPIVL; VQPIVLPEK; I | |
| | VLPEKDSW; VLPEKDSWT; LPEKDSWTV; SWTVNDIQK; WTVNDIQ | |
| | KL; TVNDIQKLV; KLVGKLNWA; KLNWASQIY; WASQIYPGI; ASQIYP | |
| | GIK; SQIYPGIKV; QIYPGIKVR; YPGIKVRQL; GIKVRQLCK; LCKLLRG | |
| | TK; KLLRGTKAL; LLRGTKALT; KALTEVIPL; ALTEVIPLT; EVIPLTEEA; | |
| | IPLTEEAEL; EEAELELAE; ELAENREIL; LAENREILK; ILKEPVHGV; K | |
| | EPVHGVYY; HGVYYDPSK; VYYDPSKDL; YYDPSKDLI; IQKQGQGQ | |
| | W; KQGQGQWTY; GQGQWTYQI; TYQIYQEPF; YQIYQEPFK; IYQEP | |

| Protein accession no/ name | Antigenic peptides | SEQ ID NO |
|---|---|---|
| | FKNL; NLKTGKYAR; KTGKYARMR; KYARMRGAH; YARMRGAHT; D VKQLTEAV; KQLTEAVQK; QLTEAVQKI; VQKITTESI; KITTESIVI; ITT ESIVIW; ESIVIWGKT; IVIWGKTPK; IWGKTPKFK; KTPKFKLPI; IQKET WETW; ETWETWWTE; TWETWWTEY; WETWWTEYW; ETWWTEY WQ; WTEYWQATW; TEYWQATWI; WQATWIPEW; ATWIPEWEF; IPE WEFVNT; WEFVNTPPL; EFVNTPPLV; FVNTPPLVK; NTPPLVKLW; T PPLVKLWY; PLVKLWYQL; WYQLEKEPI; YQLEKEPIV; EPIVGAETF; PIVGAETFY; IVGAETFYV; AETFYVDGA; ETFYVDGAA; FYVDGAAN R; ANRETKLGK; ETKLGKAGY; KLGKAGYVT; YVTNRGRQK; VTNRG RQKV; RGRQKVVTL; TLTDTTNQK; DTTNQKTEL; TTNQKTELQ; NQK TELQAI; ELQAIYLAL; LQAIYLALQ; YLALQDSGL; ALQDSGLEV; EVNI VTDSQ; IVTDSQYAL; YALGIIQAQ; AQPDQSESE; QPDQSESEL; SES ELVNQI; ELVNQIIEQ; LVNQIIEQL; QIIEQLIKK; QLIKKEKVY; LIKKEK VYL; KEKVYLAWV; KVYLAWVPA; YLAWVPAHK; KGIGGNEQV; EQV DKLVSA; KLVSAGIRK; LVSAGIRKV; VLFLDGIDK; FLDGIDKAQ; KYH SNWRAM; NWRAMASDF; RAMASDFNL; ASDFNLPPV; LPPVVAKEI; PPVVAKEIV; ASCDKCQLK; GQVDCSPGI; DCSPGIWQL; IWQLDCTH L; WQLDCTHLE; THLEGKVIL; HLEGKVILV; EGKVILVAV; KVILVAVH V; VILVAVHVA; VAVHVASGY; AVHVASGYI; HVASGYIEA; YIEAEVIP A; AEVIPAETG; IPAETGQET; AETGQETAY; ETGQETAYF; GQETAYF LL; QETAYFLLK; ETAYFLLKL; YFLLKLAGR; LKLAGRWPV; KLAGRW PVK; GRWPVKTIH; WPVKTIHTD; HTDNGSNFT; SNFTGATVR; FTGA TVRAA; GATVRAACW; ATVRAACWW; RAACWWAGI; AACWWAGIK; WWAGIKQEF; IKQEFGIPY; ESMNKELKK; SMNKELKKI; ELKKIIGQV; IIGQVRDQA; HLKTAVQMA; LKTAVQMAV; KTAVQMAVF; TAVQMAV FI; AVQMAVFIH; VQMAVFIHN; QMAVFIHNF; MAVFIHNFK; AVFIHNF KR; VFIHNFKRK; KRKGGIGGY; IIATDIQTK; ELQKQITKI; KQITKIQNF; QITKIQNFR; ITKIQNFRV; KIQNFRVYY; IQNFRVYYR; FRVYYRDSR; YYRDSRNPL; PLWKGPAKL; KLLWKGEGA; LLWKGEGAV; VIQDNS DIK; IQDNSDIKV; NSDIKVVPR; KVVPRRKAK; VPRRKAKII; KQMAGD DCV; QMAGDDCVA<br>10-mers:<br>RASVLSGGEL; SVLSGGELDR; VLSGGELDRW; ELDRWEKIRL; KIRL RPGGKK; RLRPGGKKKY; RPGGKKKYKL; KKYKLKHIVW; KLKHIVW ASR; IVWASRELER; VWASRELERF; LERFAVNPGL; ERFAVNPGLL; FAVNPGLLET; ETSEGCRQIL; RQILGQLQPS; QILGQLQPSL; ILGQL QPSLQ; SLQTGSEELR; EELRSLYNTV; RSLYNTVATL; SLYNTVATL Y; VATLYCVHQR; ATLYCVHQRI; LYCVHQRIEI; IEIKDTKEAL; AADT GHSNQV; NQVSQNYPIV; SQNYPIVQNI; PIVQNIQGQM; IVQNIQGQ MV; VQNIQGQMVH; NIQGQMVHQA; IQGQMVHQAI; QMVHQAISPR; AISPRTLNAW; RTLNAWVKVV; NAWVKVVEEK; WVKVVEEKAF; VEE KAFSPEV; EEKAFSPEVI; KAFSPEVIPM; AFSPEVIPMF; PEVIPMFSA L; EVIPMFSALS; PMFSALSEGA; ATPQDLNTML; MLNTVGGHQA; NT VGGHQAAM; GHQAAMQMLK; AAMQMLKETI; MLKETINEEA; ETINE EAAEW; AAEWDRVHPV; RVHPVHAGPI; HPVHAGPIAP; IAPGQMRE PR; TSTLQEQIGW; STLQEQIGWM; TLQEQIGWMT; WMTNNPPIPV; NPPIPVGEIY; IPVGEIYKRW; GEIYKRWIIL; IYKRWIILGL; KRWIILGL NK; RWIILGLNKI; WIILGLNKIV; IILGLNKIVR; ILGLNKIVRM; IVRMYSP TSI; MYSPTSILDI; YSPTSILDIR; SILDIRQGPK; DIRQGPKEPF; EPFR DYVDRF; DYVDRFYKTL; YVDRFYKTLR; RFYKTLRAEQ; RAEQASQ EVK; EVKNWMTETL; WMTETLLVQN; LVQNANPDCK; KTILKALGPA; TILKALGPAA; ILKALGPAAT; GPAATLEEMM; ATLEEMMTAC; TLEE MMTACQ; EEMMTACQGV; VGGPGHKARV; RVLAEAMSQV; VLAEA MSQVT; AEAMSQVTNS; EAMSQVTNSA; AMSQVTNSAT; SQVTNSA TIM; QVTNSATIMM; TNSATIMMQR; ATIMMQRGNF; TIMMQRGNFR; MMQRGNFRNQ; MQRGNFRNQR; NFRNQRKIVK; KIVKCFNCGK; KE GHTARNCR; HTARNCRAPR; TARNCRAPRK; ARNCRAPRKK; RAPR KKGCWK; APRKKGCWKC; RKKGCWKCGK; KCGKEGHQMK; QMKD CTERQA; CTERQANFLR; RQANFLREDL; NFLREDLAFL; FLREDLAF LQ; DLAFLQGKAR; AFLQGKAREF; REFSSEQTRA; EQTRANSPTR; QTRANSPTRR; RANSPTRREL; SPTRRELQVW; NSPSEAGADR; EA GADRQGTV; GTVSFNFPQV; VSFNFPQVTL; NFPQVTLWQR; QVTL WQRPLV; TLWQRPLVTI; WQRPLVTIKI; VTIKIGGQLK; KIGGQLKEA L; ALLDTGADDT; LLDTGADDTV; GADDTVLEEM; MSLPGRWKPK; S LPGRWKPKM; LPGRWKPKMI; RWKPKMIGGI; KMIGGIGGFI; MIGGI GGFIK; FIKVRQYDQI; KVRQYDQILI; RQYDQILIEI; QILIEICGHK; ILIEI CGHKA; GTVLVGPTPV; VLVGPTPVNI; LVGPTPVNII; TPVNIIGRNL; II GRNLLTQI; NLLTQIGCTL; TQIGCTLNFP; QIGCTLNFPI; CTLNFPISPI; FPISPIETVP; PISPIETVPV; ISPIETVPVK; SPIETVPVKL; TVPVKLKP GM; KLKPGMDGPK; KQWPLTEEKI; WPLTEEKIKA; PLTEEKIKAL; LT EEKIKALV; EEKIKALVEI; KALVEICTEM; LVEICTEMEK; MEKEGKISK I; ISKIGPENPY; GPENPYNTPV; PENPYNTPVF; NPYNTPVFAI; PYNT PVFAIK; YNTPVFAIKK; NTPVFAIKKK; FAIKKKDSTK; KKKDSTKWRK; STKWRKLVDF; KLVDFRELNK; LVDFRELNKR; RELNKRTQDF; RTQ DFWEVQL; WEVQLGIPHP; EVQLGIPHPA; QLGIPHPAGL; GIPHPAG | |

| Protein accession no/ name | Antigenic peptides | SEQ ID NO |
|---|---|---|
| | LKK; IPHPAGLKKK; GLKKKKSVTV; VTVLDVGDAY; TVLDVGDAYF; V LDVGDAYFS; YFSVPLDEDF; FSVPLDEDFR; SVPLDEDFRK; VPLDE DFRKY; PLDEDFRKYT; DFRKYTAFTI; KYTAFTIPSI; FTIPSINNET; SI NNETPGIR; NETPGIRYQY; YQYNVLPQGW; QYNVLPQGWK; LPQG WKGSPA; SPAIFQSSMT; PAIFQSSMTK; AIFQSSMTKI; IFQSSMTKIL; SSMTKILEPF; SMTKILEPFR; MTKILEPFRK; KQNPDIVIYQ; NPDIVIY QYM; IVIYQYMDDL; VIYQYMDDLY; IYQYMDDLYV; YMDDLYVGSD; DLYVGSDLEI; LEIGQHRTKI; KIEELRQHLL; EELRQHLLRW; RQHLL RWGLT; HLLRWGLTTP; LLRWGLTTPD; LRWGLTTPDK; RWGLTTP DKK; LTTPDKKHQK; KHQKEPPFLW; HQKEPPFLWM; KEPPFLWMG Y; FLWMGYELHP; MGYELHPDKW; YELHPDKWTV; ELHPDKWTVQ; HPDKWTVQPI; TVQPIVLPEK; VLPEKDSWTV; DSWTVNDIQK; SWT VNDIQKL; WTVNDIQKLV; KLVGKLNWAS; NWASQIYPGI; WASQIYP GIK; QIYPGIKVRQ; IYPGIKVRQL; KVRQLCKLLR; RQLCKLLRGT; QL CKLLRGTK; KLLRGTKALT; ALTEVIPLTE; EVIPLTEEAE; VIPLTEEAE L; PLTEEAELEL; EAELELAENR; LELAENREIL; ELAENREILK; EILKE PVHGV; ILKEPVHGVY; VYYDPSKDLI; DPSKDLIAEI; AEIQKQGQGQ; KQGQGQWTYQ; GQGQWTYQIY; WTYQIYQEPF; TYQIYQEPFK; QI YQEPFKNL; IYQEPFKNLK; EPFKNLKTGK; PFKNLKTGKY; KNLKTG KYAR; NLKTGKYARM; LKTGKYARMR; RMRGAHTNDV; KQLTEAVQ KI; AVQKITTESI; VQKITTESIV; KITTESIVIW; TTESIVIWGK; SIVIWGK TPK; IVIWGKTPKF; VIWGKTPKFK; IWGKTPKFKL; LPIQKETWET; ET WETWWTEY; ETWWTEYWQA; YWQATWIPEW; WQATWIPEWE; Q ATWIPEWEF; ATWIPEWEFV; WIPEWEFVNT; WEFVNTPPLV; EFVN TPPLVK; FVNTPPLVKL; NTPPLVKLWY; LVKLWYQLEK; QLEKEPIV GA; EPIVGAETFY; PIVGAETFYV; AETFYVDGAA; TFYVDGAANR; YV DGAANRET; AANRETKLGK; RETKLGKAGY; ETKLGKAGYV; KAGYV TNRGR; GYVTNRGRQK; YVTNRGRQKV; VTNRGRQKVV; NRGRQK VVTL; VTLTDTTNQK; TLTDTTNQKT; NQKTELQAIY; TELQAIYLAL; E LQAIYLALQ; IYLALQDSGL; LALQDSGLEV; LQDSGLEVNI; EVNIVTD SQY; NIVTDSQYAL; SQYALGIIQA; AQPDQSESEL; SESELVNQII; EL VNQIIEQL; LVNQIIEQLI; NQIIEQLIKK; QLIKKEKVYL; LIKKEKVYLA; E KVYLAWVPA; KVYLAWVPAH; VYLAWVPAHK; YLAWVPAHKG; LAW VPAHKGI; QVDKLVSAGI; KLVSAGIRKV; VSAGIRKVLF; KVLFLDGID K; VLFLDGIDKA; FLDGIDKAQD; DEHEKYHSNW; WRAMASDFNL; M ASDFNLPPV; NLPPVVAKEI; LPPVVAKEIV; PPVVAKEIVA; IVASCDK CQL; VASCDKCQLK; GIWQLDCTHL; THLEGKVILV; HLEGKVILVA; K VILVAVHVA; LVAVHVASGY; VASGYIEAEV; AEVIPAETGQ; IPAETG QETA; PAETGQETAY; AETGQETAYF; ETGQETAYFL; GQETAYFLL K; QETAYFLLKL; ETAYFLLKLA; AYFLLKLAGR; YFLLKLAGRW; LLKL AGRWPV; LKLAGRWPVK; KLAGRWPVKT; TIHTDNGSNF; NGSNFT GATV; GSNFTGATVR; TGATVRAACW; GATVRAACWW; ATVRAAC WWA; RAACWWAGIK; CWWAGIKQEF; GIKQEFGIPY; IPYNPQSQG V; SQGVVESMNK; GVVESMNKEL; VVESMNKELK; SMNKELKKII; EL KKIIGQVR; GQVRDQAEHL; QVRDQAEHLK; AEHLKTAVQM; HLKTA VQMAV; KTAVQMAVFI; TAVQMAVFIH; VQMAVFIHNF; QMAVFIHNF K; MAVFIHNFKR; AVFIHNFKRK; FKRKGGIGGY; RIVDIIATDI; DIIATDI QTK; KQITKIQNFR; QITKIQNFRV; ITKIQNFRVY; KIQNFRVYYR; NFR VYYRDSR; VYYRDSRNPL; YYRDSRNPLW; RNPLWKGPAK; NPLWK GPAKL; PLWKGPAKLL; KLLWKGEGAV; LLWKGEGAVV; VVIQDNSD IK; VIQDNSDIKV; IQDNSDIKVV; DNSDIKVVPR; NSDIKVVPRR; RRK AKIIRDY; KAKIIRDYGK; KIIRDYGKQM; IIRDYGKQMA; KQMAGDDC VA; MAGDDCVASR 11-mers: VLSGGELDRWE; LSGGELDRWEK; GELDRWEKIRL; ELDRWEKIRL R; KIRLRPGGKKK; RLRPGGKKKYK; HIVWASRELER; WASRELERF AV; ELERFAVNPGL; LERFAVNPGLL; GLLETSEGCRQ; LLETSEGCR QI; LETSEGCRQIL; SEGCRQILGQL; RQILGQLQPSL; ILGQLQPSLQ T; QPSLQTGSEEL; LQTGSEELRSL; QTGSEELRSLY; SEELRSLYNT V; RSLYNTVATLY; SLYNTVATLYC; LYNTVATLYCV; NTVATLYCVH Q; TVATLYCVHQR; TLYCVHQRIEI; LYCVHQRIEIK; EIKDTKEALDK; ALDKIEEEQNK; AAADTGHSNQV; HSNQVSQNYPI; YPIVQNIQGQM; PIVQNIQGQMV; NIQGQMVHQAI; GQMVHQAISPR; MVHQAISPRTL; QAISPRTLNAW; AISPRTLNAWV; ISPRTLNAWVK; SPRTLNAWVKV; LNAWVKVVEEK; AWVKVVEEKAF; VVEEKAFSPEV; KAFSPEVIPMF; FSPEVIPMFSA; SPEVIPMFSAL; EVIPMFSALSE; IPMFSALSEGA; A LSEGATPQDL; EGATPQDLNTM; PQDLNTMLNTV; TMLNTVGGHQA; MLNTVGGHQAA; TVGGHQAAMQM; GGHQAAMQMLK; QAAMQML KETI; MQMLKETINEE; QMLKETINEEA; MLKETINEEAA; TINEEAAE WDR; EAAEWDRVHPV; RVHPVHAGPIA; HPVHAGPIAPG; HAGPIAP GQMR; TTSTLQEQIGW; QIGWMTNNPPI; IPVGEIYKRWI; EIYKRWII LGL; KRWIILGLNKI; WIILGLNKIVR; IILGLNKIVRM; KIVRMYSPTSI; IV RMYSPTSIL; RMYSPTSILDI; MYSPTSILDIR; TSILDIRQGPK; DIRQG PKEPFR; RQGPKEPFRDY; QGPKEPFRDYV; EPFRDYVDRFY; PFR DYVDRFYK; DYVDRFYKTLR; YVDRFYKTLRA; TLRAEQASQEV; AE | |

| Protein accession no/ name | Antigenic peptides | SEQ ID NO |
|---|---|---|
| | QASQEVKNW; QEVKNWMTETL; EVKNWMTETLL; WMTETLLVQNA; LLVQNANPDCK; NANPDCKTILK; NPDCKTILKAL; KTILKALGPAA; IL KALGPAATL; ALGPAATLEEM; EEMMTACQGVG; MTACQGVGGPG; ACQGVGGPGHK; GVGGPGHKARV; KARVLAEAMSQ; AEAMSQVT NSA; EAMSQVTNSAT; AMSQVTNSATI; MSQVTNSATIM; SQVTNSA TIMM; VTNSATIMMQR; ATIMMQRGNFR; MMQRGNFRNQR; MQRG NFRNQRK; FRNQRKIVKCF; HTARNCRAPRK; TARNCRAPRKK; EG HQMKDCTER; DCTERQANFLR; RQANFLREDLA; QANFLREDLAF; L AFLQGKAREF; FLQGKAREFSS; KAREFSSEQTR; EQTRANSPTRR; TRANSPTRREL; NSPTRRELQVW; LQVWGRDNNSP; QGTVSFNFP QV; TVSFNFPQVTL; VSFNFPQVTLW; FNFPQVTLWQR; FPQVTLW QRPL; VTLWQRPLVTI; TLWQRPLVTIK; LWQRPLVTIKI; PLVTIKIGG QL; LVTIKIGGQLK; KIGGQLKEALL; QLKEALLDTGA; ALLDTGADDT V; LLDTGADDTVL; TGADDTVLEEM; TVLEEMSLPGR; SLPGRWKPK MI; GRWKPKMIGGI; KPKMIGGIGGF; KMIGGIGGFIK; MIGGIGGFIKV; GFIKVRQYDQI; FIKVRQYDQIL; RQYDQILIEIC; DQILIEICGHK; ILIEI CGHKAI; EICGHKAIGTV; TVLVGPTPVNI; VLVGPTPVNII; TPVNIIGR NLL; NIIGRNLLTQI; LLTQIGCTLNF; TQIGCTLNFPI; TLNFPISPIET; L NFPISPIETV; FPISPIETVPV; ETVPVKLKPGM; KLKPGMDGPKV; GM DGPKVKQWP; KVKQWPLTEEK; KQWPLTEEKIK; WPLTEEKIKAL; P LTEEKIKALV; ALVEICTEMEK; EICTEMEKEGK; KISKIGPENPY; GPE NPYNTPVF; ENPYNTPVFAI; NPYNTPVFAIK; PYNTPVFAIKK; FAIKK KDSTKW; AIKKKDSTKWR; KKDSTKWRKLV; STKWRKLVDFR; KLVD FRELNKR; TQDFWEVQLGI; WEVQLGIPHPA; VQLGIPHPAGL; QLGI PHPAGLK; LGIPHPAGLKK; GIPHPAGLKKK; IPHPAGLKKKK; HPAGL KKKKSV; GLKKKKSVTVL; SVTVLDVGDAY; VTVLDVGDAYF; VLDVG DAYFSV; DVGDAYFSVPL; AYFSVPLDEDF; YFSVPLDEDFR; FSVPL DEDFRK; SVPLDEDFRKY; PLDEDFRKYTA; RKYTAFTIPSI; IPSINNE TPGI; SINNETPGIRY; ETPGIRYQYNV; TPGIRYQYNVL; RYQYNVLP QGW; YQYNVLPQGWK; VLPQGWKGSPA; LPQGWKGSPAI; KGSPA IFQSSM; SPAIFQSSMTK; AIFQSSMTKIL; QSSMTKILEPF; SSMTKIL EPFR; SMTKILEPFRK; EPFRKQNPDIV; KQNPDIVIYQY; DIVIYQYMD DL; IVIYQYMDDLY; VIYQYMDDLYV; YQYMDDLYVGS; YMDDLYVG SDL; DLEIGQHRTKI; GQHRTKIEELR; KIEELRQHLLR; ELRQHLLRW GL; RQHLLRWGLTT; LLRWGLTTPDK; LRWGLTTPDKK; KKHQKEPP FLW; EPPFLWMGYEL; FLWMGYELHPD; LWMGYELHPDK; ELHPDK WTVQP; HPDKWTVQPIV; WTVQPIVLPEK; QPIVLPEKDSW; IVLPEK DSWTV; TVNDIQKLVGK; IQKLVGKLNWA; KLVGKLNWASQ; LVGKL NWASQI; KLNWASQIYPG; WASQIYPGIKV; ASQIYPGIKVR; QIYPGI KVRQL; RQLCKLLRGTK; KLLRGTKALTE; LLRGTKALTEV; GTKALT EVIPL; ALTEVIPLTEE; EVIPLTEEAEL; IPLTEEAELEL; PLTEEAELEL A; EEAELELAENR; AELELAENREI; ELELAENREIL; AENREILKEPV; REILKEPVHGV; EILKEPVHGVY; ILKEPVHGVYY; EPVHGVYYDPS; P VHGVYYDPSK; AEIQKQGQGQW; IQKQGQGQWTY; KQGQGQWTY QI; QWTYQIYQEPF; WTYQIYQEPFK; YQIYQEPFKNL; QIYQEPFKNL K; EPFKNLKTGKY; NLKTGKYARMR; RMRGAHTNDVK; HTNDVKQL TEA; DVKQLTEAVQK; QLTEAVQKITT; EAVQKITTESI; VQKITTESI V; ITTESIVIWGK; ESIVIWGKTPK; SIVIWGKTPKF; IVIWGKTPKFK; VI WGKTPKFKL; KTPKFKLPIQK; KLPIQKETWET; LPIQKETWETW; IQK ETWETWWT; KETWETWWTEY; ETWETWWTEYW; WETWWTEYW QA; ETWWTEYWQAT; TWWTEYWQATW; WWTEYWQATWI; EYWQ ATWIPEW; WQATWIPEWEF; QATWIPEWEFV; PEWEFVNTPPL; WE FVNTPPLVK; EFVNTPPLVKL; FVNTPPLVKLW; KLWYQLEKEPI; YQ LEKEPIVGA; EPIVGAETFYV; ETFYVDGAANR; YVDGAANRETK; GA ANRETKLGK; RETKLGKAGYV; KLGKAGYVTNR; AGYVTNRGRQK; YVTNRGRQKVV; VVTLTDTTNQK; LTDTTNQKTEL; TTNQKTELQAI; KTELQAIYLAL; AIYLALQDSGL; YLALQDSGLEV; ALQDSGLEVNI; LQ DSGLEVNIV; LEVNIVTDSQY; EVNIVTDSQYA; IVTDSQYALGI; SQYA LGIIQAQ; AQPDQSESELV; SELVNQIIEQL; ELVNQIIEQLI; LVNQIIEQ LIK; QIIEQLIKKEK; IIEQLIKKEKV; IEQLIKKEKVY; QLIKKEKVYLA; IKK EKVYLAWV; KVYLAWVPAHK; YLAWVPAHKGI; GIGGNEQVDKL; EQ VDKLVSAGI; QVDKLVSAGIR; KLVSAGIRKVL; LVSAGIRKVLF; GIRK VLFLDGI; FLDGIDKAQDE; HSNWRAMASDF; NWRAMASDFNL; AMA SDFNLPPV; MASDFNLPPVV; NLPPVVAKEIV; LPPVVAKEIVA; EIVA SCDKCQL; IVASCDKCQLK; QLKGEAMHGQV; QVDCSPGIWQL; QL DCTHLEGKV; HLEGKVILVAV; ILVAVHVASGY; LVAVHVASGYI; AVH VASGYIEA; HVASGYIEAEV; IPAETGQETAY; AETGQETAYFL; ETG QETAYFLL; TGQETAYFLLK; GQETAYFLLKL; TAYFLLKLAGR; AYFL LKLAGRW; FLLKLAGRWPV; LLKLAGRWPVK; KLAGRWPVKTI; KTIH TDNGSNF; HTDNGSNFTGA; NGSNFTGATVR; FTGATVRAACW; TG ATVRAACWW; TVRAACWWAGI; ACWWAGIKQEF; WWAGIKQEFGI; QEFGIPYNPQS; GIPYNPQSGV; IPYNPQSGVV; NPQSGVVES M; QSQGVVESMNK; GVVESMNKELK; VVESMNKELKK; KELKKIIGQ VR; GQVRDQAEHLK; AEHLKTAVQMA; HLKTAVQMAVF; AVQMAVFI HNF; VQMAVFIHNFK; QMAVFIHNFKR; MAVFIHNFKRK; FIHNFKRK | |

| Protein accession no/ name | Antigenic peptides | SEQ ID NO |
|---|---|---|
| | GGI; GIGGYSAGERI; GYSAGERIVDI; YSAGERIVDII; IIATDIQTKEL; A TDIQTKELQK; QTKELQKQITK; LQKQITKIQNF; KQITKIQNFRV; QITK IQNFRVY; ITKIQNFRVYY; TKIQNFRVYYR; QNFRVYYRDSR; RVYY RDSRNPL; VYYRDSRNPLW; YYRDSRNPLWK; SRNPLWKGPAK; N PLWKGPAKLL; KLLWKGEGAVV; LLWKGEGAVVI; AVVIQDNSDIK; V VIQDNSDIKV; VIQDNSDIKVV; DNSDIKVVPRR; DIKVVPRRKAK; VV PRRKAKIIR; KQMAGDDCVAS; QMAGDDCVASR | |
| 15-mer + 9-mer core | ADDTVLEEMSLPGRW; LEEMSLPGR; AEAMSQVTNSATIMM; AMS QVTNSA; AEAMSQVTNSATIMM; MSQVTNSAT; AEAMSQVTNSATI MM; QVTNSATIM; AEHLKTAVQMAVFIH; LKTAVQMAV; AENREILKE PVHGVY; ILKEPVHGV; AETFYVDGAANRETK; YVDGAANRE; AFLQ GKAREFSSEQT; LQGKAREFS; AFSPEVIPMFSALSE; VIPMFSALS; AFTIPSINNETPGIR; IPSINNETP; AFTIPSINNETPGIR; PSINNETPG; AGERIVDIIATDIQT; IVDIIATDI; AGIKQEFGIPYNPQS; IKQEFGIPY; A GLKKKKSVTVLDVG; LKKKKSVTV; AGPIAPGQMREPRGS; IAPGQM REP; AGRWPVKTIHTDNGS; VKTIHTDNG; AGYVTNRGRQKVVTL; V TNRGRQKV; AGYVTNRGRQKVVTL; YVTNRGRQK; AIFQSSMTKILE PFR; FQSSMTKIL; AIGTVLVGPTPVNII; IGTVLVGPT; AIGTVLVGPTP VNII; LVGPTPVNI; AIGTVLVGPTPVNII; VLVGPTPVN; AISPRTLNAW VKVVE; PRTLNAWVK; AISPRTLNAWKVVE; TLNAWVKVV; AIYLAL QDSGLEVNI; YLALQDSGL; AKLLWKGEGAVVIQD; WKGEGAVVI; AL GIIQAQPDQSESE; IIQAQPDQS; ALGIIQAQPDQSESE; IQAQPDQS E; AMASDFNLPPVVAKE; DFNLPPVVA; AMASDFNLPPVVAKE; MAS DFNLPP; AMSQVTNSATIMMQR; AMSQVTNSA; AMSQVTNSATIMM QR; VTNSATIMM; AREFSSEQTRANSPT; FSSEQTRAN; ARMRGAH TNDVKQLT; MRGAHTNDV; ARVLAEAMSQVTNSA; LAEAMSQVT; A RVLAEAMSQVTNSA; VLAEAMSQV; ASDFNLPPVVAKEIV; DFNLPP VVA; ASQEVKNWMTETLLV; VKNWMTETL; ASQIYPGIKVRQLCK; Y PGIKVRQL; ASRELERFAVNPGLL; LERFAVNPG; ATDIQTKELQKQI TK; IQTKELQKQ; ATIMMQRGNFRNQRK; IMMQRGNFR; ATLEEMMT ACQGVGG; LEEMMTACQ; ATPQDLNTMLNTVGG; LNTMLNTVG; AT VRAACWWAGIKQE; VRAACWWAG; ATWIPEWEFVNTPPL; ATWIP EWEF; ATWIPEWEFVNTPPL; PEWEFVNTP; AVFIHNFKRKGGIGG; FIHNFKRKG; AVFIHNFKRKGGIGG; IHNFKRKGG; AVQKITTESIVIW GK; VQKITTESI; AVQMAVFIHNFKRKG; VQMAVFIHN; AYFLLKLAGR WPVKT; LKLAGRWPV; AYFLLKLAGRWPVKT; LLLKLAGRWP; AYFLL KLAGRWPVKT; YFLLKLAGR; CDKCQLKGEAMHGQV; LKGEAMHG Q; CGHKAIGTVLVGPTP; HKAIGTVLV; CGHKAIGTVLVGPTP; IGTVL VGPT; CKLLRGTKALTEVIP; LRGTKALTE; CKTILKALGPAATLE; ILK ALGPAA; CKTILKALGPAATLE; LKALGPAAT; CQLKGEAMHGQVDC S; LKGEAMHGQ; CRQILGQLQPSLQTG; GQLQPSLQT; CRQILGQLQ PSLQTG; LGQLQPSLQ; CTHLEGKVILVAVHV; LEGKVILVA; CTLNFP ISPIETVPV; FPISPIETV; DAYFSVPLDEDFRKY; YFSVPLDED; DCKTI LKALGPAATL; ILKALGPAA; DCKTILKALGPAATL; LKALGPAAT; DDL YVGSDLEIGQHR; YVGSDLEIG; DDTVLEEMSLPGRWK; LEEMSLP GR; DEDFRKYTAFTIPSI; FRKYTAFTI; DEDFRKYTAFTIPSI; KYTAFT IPS; DEHEKYHSNWRAMAS; EKYHSNWRA; DEHEKYHSNWRAMAS; YHSNWRAMA; DFNLPPVVAKEIVAS; DFNLPPVVA; DFRKYTAFTIP SINN; FRKYTAFTI; DFRKYTAFTIPSINN; YTAFTIPSI; DFWEVQLGIP HPAGL; VQLGIPHPA; DGPKVKQWPLTEEKI; VKQWPLTEE; DIAGTT STLQEQIGW; IAGTTSTLQ; DIIATDIQTKELQKQ; ATDIQTKEL; DIKVV PRRKAKIIRD; IKVVPRRKA; DIQKLVGKLNWASQI; LVGKLNWAS; DI QTKELQKQITKIQ; IQTKELQKQ; DIVIYQYMDDLYVGS; YQYMDDLY V; DKCQLKGEAMHGQVD; LKGEAMHGQ; DKLVSAGIRKVLFLD; LVS AGIRKV; DKWTVQPIVLPEKDS; WTVQPIVLP; DLAFLQGKAREFSSE; FLQGKAREF; DLNTMLNTVGGHQAA; LNTMLNTVG; DLNTMLNTVG GHQAA; MLNTVGGHQ; DLYVGSDLEIGQHRT; YVGSDLEIG; DNGS NFTGATVRAAC; FTGATVRAA; DNSDIKVVPRRKAKI; IKVVPRRKA; DQAEHLKTAVQMAVF; LKTAVQMAV; DQILIEICGHKAIGT; LIEICGH KA; DRFYKTLRAEQASQE; DRFYKTLRA; DRFYKTLRAEQASQE; FY KTLRAEQ; DRFYKTLRAEQASQE; YKTLRAEQA; DRVHPVHAGPIAP GQ; VHAGPIAPG; DSGLEVNIVTDSQYA; LEVNIVTDS; DSQYALGIIQ AQPDQ; YALGIIQAQ; DSRNPLWKGPAKLLW; LWKGPAKLL; DTVLE EMSLPGRWKP; LEEMSLPGR; DVGDAYFSVPLDEDF; YFSVPLDED; DYVDRFYKTLRAEQA; DRFYKTLRA; DYVDRFYKTLRAEQA; FYKTL RAEQ; DYVDRFYKTLRAEQA; VDRFYKTLR; DYVDRFYKTLRAEQA; YVDRFYKTL; EAMSQVTNSATIMMQ; AMSQVTNSA; EAMSQVTNSA TIMMQ; VTNSATIMM; EAVQKITTESIVIWG; VQKITTESI; EDFRKYTA FTIPSIN; FRKYTAFTI; EDFRKYTAFTIPSIN; YTAFTIPSI; EDLAFLQG KAREFSS; FLQGKAREF; EDLAFLQGKAREFSS; LAFLQGKAR; EEKI KALVEICTEME; IKALVEICT; EELRQHLLRWGLTTP; LRQHLLRWG; E ELRSLYNTVATLYC; LRSLYNTVA; EELRSLYNTVATLYC; LYNTVAT LY; EFGIPYNPQSQGVVE; PYNPQSQGV; EFSSEQTRANSPTRR; FS SEQTRAN; EFSSEQTRANSPTRR; QTRANSPTR; EFVNTPPLVKLW | |

| Protein accession no/ name | Antigenic peptides | SEQ ID NO |
|---|---|---|
| | YQL; FVNTPPLVK; EFVNTPPLVKLWYQL; VNTPPLVKL; EGCRQILG QLQPSLQ; CRQILGQLQ; EGCRQILGQLQPSLQ; ILGQLQPSL; EGCR QILGQLQPSLQ; RQILGQLQP; EGKISKIGPENPYNT; ISKIGPENP; E GKVILVAVHVASGY; LVAVHVASG; EGKVILVAVHVASGY; VILVAVH VA; EHEKYHSNWRAMASD; HSNWRAMAS; EHEKYHSNWRAMASD; YHSNWRAMA; EHLKTAVQMAVFIHN; LKTAVQMAV; EICGHKAIGT VLVGP; HKAIGTVLV; EIYKRWIILGLNKIV; WIILGLNKI; EIYKRWIILGL NKIV; YKRWIILGL; EKEPIVGAETFYVDG; IVGAETFYV; EKIKALVEIC TEMEK; IKALVEICT; EKVYLAWVPAHKGIG; LAWVPAHKG; EKVYLA WVPAHKGIG; VYLAWVPAH; EKVYLAWVPAHKGIG; YLAWVPAHK; EKYHSNWRAMASDFN; HSNWRAMAS; EKYHSNWRAMASDFN; YH SNWRAMA; ELERFAVNPGLLETS; FAVNPGLLE; ELHPDKWTVQPIV LP; DKWTVQPIV; ELHPDKWTVQPIVLP; KWTVQPIVL; ELQAIYLALQ DSGLE; LQAIYLALQ; ELQKQITKIQNFRVY; ITKIQNFRV; ELQKQITKI QNFRVY; LQKQITKIQ; ELRQHLLRWGLTTPD; LLRWGLTTP; ELRQH LLRWGLTTPD; LRQHLLRWG; ELRSLYNTVATLYCV; LYNTVATLY; E LRSLYNTVATLYCV; YNTVATLYC; ELVNQIIEQLIKKEK; VNQIIEQLI; ENREILKEPVHGVYY; ILKEPVHGV; EPFKNLKTGKYARMR; FKNLKT GKY; EPFKNLKTGKYARMR; LKTGKYARM; EPFRKQNPDIVIYQY; F RKQNPDIV; EPIVGAETFYVDGAA; IVGAETFYV; EPPFLWMGYELH PDK; FLWMGYELH; EPRGSDIAGTTSTLQ; EPRGSDIAG; EPRGSDIA GTTSTLQ; GSDIAGTTS; EPRGSDIAGTTSTLQ; RGSDIAGTT; EQAS QEVKNWMTETL; EVKNWMTET; EQASQEVKNWMTETL; SQEVKN WMT; EQIGWMTNNPPIPVG; IGWMTNNPP; EQIGWMTNNPPIPVG; MTNNPPIPV; EQLIKKEKVYLAWVP; IKKEKVYLA; EQVDKLVSAGIR KVL; LVSAGIRKV; ERFAVNPGLLETSEG; FAVNPGLLE; ERFAVNPG LLETSEG; VNPGLLETS; ERIVDIIATDIQTKE; IVDIIATDI; ESELVNQII EQLIKK; LVNQIIEQL; ESIVIWGKTPKFKLP; IVIWGKTPK; ESIVIWGK TPKFKLP; IWGKTPKFK; ESIVIWGKTPKFKLP; VIWGKTPKF; ESMNK ELKKIIGQVR; MNKELKKII; ETAYFLLKLAGRWPV; AYFLLKLAG; ETA YFLLKLAGRWPV; FLLKLAGRW; ETAYFLLKLAGRWPV; YFLLKLAG R; ETFYVDGAANRETKL; YVDGAANRE; ETLLVQNANPDCKTI; VQN ANPDCK; ETPGIRYQYNVLPQG; IRYQYNVLP; ETVPVKLKPGMDGP K; VKLKPGMDG; ETWETWWTEYWQATW; WETWWTEYW; ETWWT EYWQATWIPE; EYWQATWIP; ETWWTEYWQATWIPE; WWTEYWQ AT; EVIPMFSALSEGATP; IPMFSALSE; EVIPMFSALSEGATP; MFSA LSEGA; EVIPMFSALSEGATP; VIPMFSALS; EVKNWMTETLLVQNA; NWMTETLLV; EVKNWMTETLLVQNA; WMTETLLVQ; EVQLGIPHPA GLKKK; VQLGIPHPA; EWEFVNTPPLVKLWY; FVNTPPLVK; EWEFV NTPPLVKLWY; VNTPPLVKL; EWEFVNTPPLVKLWY; WEFVNTPPL; EYWQATWIPEWEFVN; WQATWIPEW; FAIKKKDSTKWRKLV; IKKK DSTKW; FAVNPGLLETSEGCR; VNPGLLETS; FGIPYNPQSQGVVE S; PYNPQSQGV; FIHNFKRKGGIGGYS; FKRKGGIGG; FKNLKTGKY ARMRGA; FKNLKTGKY; FKNLKTGKYARMRGA; LKTGKYARM; FKR KGGIGGYSAGER; FKRKGGIGG; FLLKLAGRWPVKTIH; KLAGRWP VK; FLLKLAGRWPVKTIH; LAGRWPVKT; FLLKLAGRWPVKTIH; LKL AGRWPV; FLQGKAREFSSEQTR; FLQGKAREF; FLREDLAFLQGKA RE; LAFLQGKAR; FNFPQVTLWQRPLVT; FPQVTLWQR; FNFPQVTL WQRPLVT; VTLWQRPLV; FNLPPVVAKEIVASC; VVAKEIVAS; FPISP IETVPVKLP; IETVPVKLK; FPISPIETVPVKLP; ISPIETVPV; FPQVT LWQRPLVTIK; LWQRPLVTI; FPQVTLWQRPLVTIK; TLWQRPLVT; F PQVTLWQRPLVTIK; VTLWQRPLV; FQSSMTKILEPFRKQ; FQSSMT KIL; FQSSMTKILEPFRKQ; TKILEPFRK; FRKQNPDIVIYQYMD; FRKQ NPDIV; FRKYTAFTIPSINNE; FRKYTAFTI; FRKYTAFTIPSINNE; YTA FTIPSI; FRNQRKIVKCFNCGK; FRNQRKIVK; FRVYYRDSRNPLWKG; FRVYYRDSR; FRVYYRDSRNPLWKG; YRDSRNPLW; FRVYYRDSR NPLWKG; YYRDSRNPL; FSPEVIPMFSALSEG; VIPMFSALS; FSSEQ TRANSPTRRE; FSSEQTRAN; FSSEQTRANSPTRRE; QTRANSPTR; FSSEQTRANSPTRRE; TRANSPTRR; FTGATVRAACWWAGI; FTGA TVRAA; FTIPSINNETPGIRY; INNETPGIR; FVNTPPLVKLWYQLE; FV NTPPLVK; FVNTPPLVKLWYQLE; VNTPPLVKL; FWEVQLGIPHPAG LK; VQLGIPHPA; FYKTLRAEQASQEVK; FYKTLRAEQ; FYKTLRAEQ ASQEVK; YKTLRAEQA; FYVDGAANRETKLGK; VDGAANRET; GAD DTVLEEMSLPGR; VLEEMSLPG; GAETFYVDGAANRET; YVDGAAN RE; GATPQDLNTMLNTVG; DLNTMLNTV; GATPQDLNTMLNTVG; P QDLNTMLN; GATVRAACWWAGIKO; VRAACWWAG; GCRQILGQLQ PSLQT; LGQLQPSLQ; GCTLNFPISPIETVP; FPISPIETV; GDAYFSVP LDEDFRK; YFSVPLDED; GEIYKRWIILGLNKI; IYKRWIILG; GEIYKR WIILGLNKI; YKRWIILGL; GERIVDIIATDIQTK; IVDIIATDI; GGHQAAM QMLKETIN; AAMQMLKET; GHKAIGTVLVGPTPV; HKAIGTVLV; GHK AIGTVLVGPTPV; IGTVLVGPT; GHKARVLAEAMSQVT; VLAEAMSQ V; GIIQAQPDQSESELV; IIQAQPDQS; GIIQAQPDQSESELV; IQAQP DQSE; GIKVRQLCKLLRGTK; VRQLCKLLR; GIPYNPQSQGVVESM; PYNPQSQGV; GIRYQYNVLPQGWKG; IRYQYNVLP; GIRYQYNVLP QGWKG; YQYNVLPQG; GKAGYVTNRGRQKVV; VTNRGRQKV; GKA | |

| Protein accession no/ name | Antigenic peptides | SEQ ID NO |
|---|---|---|
| | GYVTNRGRQKVV; YVTNRGRQK; GKAREFSSEQTRANS; FSSEQT RAN; GKISKIGPENPYNTP; IGPENPYNT; GKKKYKLKHIVWASR; YKL KHIVWA; GKVILVAVHVASGYI; LVAVHVASG; GKVILVAVHVASGYI; VILVAVHVA; GKYARMRGAHTNDVK; MRGAHTNDV; GKYARMRGA HTNDVK; YARMRGAHT; GLEVNIVTDSQYALG; VNIVTDSQY; GLKK KKSVTVLDVGD; LKKKKSVTV; GLNKIVRMYSPTSIL; IVRMYSPTS; G LNKIVRMYSPTSIL; LNKIVRMYS; GLNKIVRMYSPTSIL; VRMYSPTSI; GMDGPKVKQWPLTEE; KVKQWPLTE; GNEQVDKLVSAGIRK; VDK LVSAGI; GNFRNQRKIVKCFNC; FRNQRKIVK; GPAKLLWKGEGAVVI; LWKGEGAVV; GPKVKQWPLTEEKIK; VKQWPLTEE; GPTPVNIIGR NLLTQ; VNIIGRNLL; GPAATLEEMMTACQG; LEEMMTACQ; GQETA YFLLKLAGRW; YFLLKLAGR; GQLQPSLQTGSEELR; GQLQPSLQT; GQMVHQAISPRTLNA; MVHQAISPR; GQMVHQAISPRTLNA; VHQAI SPRT; GRNLLTQIGCTLNFP; GRNLLTQIG; GRQKVVTLTDTTNQK; V TLTDTTNQ; GRQKVVTLTDTTNQK; VVTLTDTTN; GRWPVKTIHTDN GSN; VKTIHTDNG; GSDIAGTTSTLQEQI; IAGTTSTLQ; GSEELRSLY NTVATL; LRSLYNTVA; GSNFTGATVRAACWW; FTGATVRAA; GSPA IFQSSMTKILE; FQSSMTKIL; GTTSTLQEQIGWMTN; LQEQIGWMT; GTVLVGPTPVNIIGR; LVGPTPVNI; GTVSFNFPQVTLWQR; VSFNFP QVT; GWKGSPAIFQSSMTK; WKGSPAIFQ; GWMTNNPPIPVGEIY; M TNNPPIPV; GYVTNRGRQKVVTLT; VTNRGRQKV; HEKYHSNWRAM ASDF; HSNWRAMAS; HEKYHSNWRAMASDF; YHSNWRAMA; HKAI GTVLVGPTPVN; HKAIGTVLV; HKAIGTVLVGPTPVN; IGTVLVGPT; H KARVLAEAMSQVTN; LAEAMSQVT; HLEGKVILVAVHVAS; VILVAVH VA; HLKTAVQMAVFIHNF; LKTAVQMAV; HLLRWGLTTPDKKHQ; LL RWGLTTP; HLLRWGLTTPDKKHQ; LRWGLTTPD; HLLRWGLTTPDK KHQ; WGLTTPDKK; HNFKRKGGIGGYSAG; FKRKGGIGG; HPAGLK KKKSVTVLD; LKKKKSVTV; HPDKWTVQPIVLPEK; WTVQPIVLP; HP VHAGPIAPGQMRE; VHAGPIAPG; HQKEPPFLWMGYELH; KEPPFL WMG; HQKEPPFLWMGYELH; QKEPPFLWM; HSNWRAMASDFNLP P; WRAMASDFN; IAGTTSTLQEQIGWM; IAGTTSTLQ; IATDIQTKELQ KQIT; IQTKELQKQ; ICGHKAIGTVLVGPT; HKAIGTVLV; IEAEVIPAET GQETA; IPAETGQET; IEELRQHLLRWGLTT; LRQHLLRWG; IEICGH KAIGTVLVG; ICGHKAIGT; IEQLIKKEKVYLAWV; IKKEKVYLA; IETVP VKLKPGMDGP; VKLKPGMDG; IFQSSMTKILEPFRK; FQSSMTKIL; IF QSSMTKILEPFRK; MTKILEPFR; IGCTLNFPISPIETV; NFPISPIET; IG PENPYNTPVFAIK; IGPENPYNT; IGRNLLTQIGCTLNF; GRNLLTQIG; IGRNLLTQIGCTLNF; IGRNLLTQI; IGTVLVGPTPVNIIG; IGTVLVGPT; IGTVLVGPTPVNIIG; LVGPTPVNI; IGTVLVGPTPVNIIG; VLVGPTPV N; IGWMTNNPPIPVGEI; IGWMTNNPP; IGWMTNNPPIPVGEI; MTNN PPIPV; IGWMTNNPPIPVGEI; WMTNNPPIP; IHNFKRKGGIGGYSA; F KRKGGIGG; IIATDIQTKELQKQI; IQTKELQKQ; IIEQLIKKEKVYLAW; I KKEKVYLA; IIGRNLLTQIGCTLN; GRNLLTQIG; IIGRNLLTQIGCTLN; I GRNLLTQI; IILGLNKIVRMYSPT; ILGLNKIVR; IILGLNKIVRMYSPT; L GLNKIVRM; IILGLNKIVRMYSPT; LNKIVRMYS; IIQAQPDQSESELVN; IIQAQPDQS; IKKEKVYLAWVPAHK; IKKEKVYLA; IKKEKVYLAWVP AHK; VYLAWVPAH; IKVRQLCKLLRGTKA; VRQLCKLLR; IKVVPRRK AKIIRDY; IKVVPRRKA; ILEPFRKQNPDIVIY; FRKQNPDIV; ILGLNKIV RMYSPTS; ILGLNKIVR; ILGLNKIVRMYSPTS; LGLNKIVRM; ILGLNKI VRMYSPTS; LNKIVRMYS; ILGQLQPSLQTGSEE; GQLQPSLQT; ILG QLQPSLQTGSEE; LGQLQPSLQ; ILIEICGHKAIGTVL; ICGHKAIGT; IL KALGPAATLEEMM; LKALGPAAT; ILVAVHVASGYIEAE; LVAVHVAS G; IMMQRGNFRNQRKIV; IMMQRGNFR; INNETPGIRYQYNVL; INNE TPGIR; IPEWEFVNTPPLVKL; FVNTPPLVK; IPEWEFVNTPPLVKL; W EFVNTPPL; IPHPAGLKKKKSVTV; GLKKKKSVT; IPHPAGLKKKKSV TV; PAGLKKKKS; IPMFSALSEGATPQD; MFSALSEGA; IPSINNETPG IRYQY; INNETPGIR; IPVGEIYKRWIILGL; IYKRWIILG; IQDNSDIKVV PRRKA; IQDNSDIKV; IQGQMVHQAISPRTL; MVHQAISPR; IQGQMV HQAISPRTL; VHQAISPRT; IQKETWETWWTEYWQ; WETWWTEYW; IQKLVGKLNWASQIY; LVGKLNWAS; IQKLVGKLNWASQIY; VGKLN WASQ; IQNFRVYYRDSRNPL; IQNFRVYYR; IQTKELQKQITKIQN; LQ KQITKIQ; IRYQYNVLPQGWKGS; IRYQYNVLP; IRYQYNVLPQGWK GS; YQYNVLPQG; ISKIGPENPYNTPVF; IGPENPYNT; ISPIETVPVKL KPGM; ISPIETVPV; ISPRTLNAWVKVVEE; LNAWVKVVE; ISPRTLNA WVKVVEE; TLNAWVKVV; ITKIQNFRVYYRDSR; IQNFRVYYR; ITKIQ NFRVYYRDSR; ITKIQNFRV; ITTESIVIWGKTPKF; ITTESIVIW; ITTES IVIWGKTPKF; IVIWGKTPK; IVGAETFYVDGAANR; IVGAETFYV; IVI WGKTPKFKLPIQ; IVIWGKTPK; IVIWGKTPKFKLPIQ; IWGKTPKFK; I VIWGKTPKFKLPIQ; VIWGKTPKF; IVIYQYMDDLYVGSD; YQYMDDL YV; IVQNIQGQMVHQAIS; IQGQMVHQA; IVRMYSPTSILDIRQ; IVRM YSPTS; IVRMYSPTSILDIRQ; VRMYSPTSI; IVRMYSPTSILDIRQ; YSP TSILDI; IVTDSQYALGIIQAQ; QYALGIIQA; IYKRWIILGLNKIVR; WIIL GLNKI; IYKRWIILGLNKIVR; YKRWIILGL; IYLALQDSGLEVNIV; LQDS GLEVN; IYPGIKVRQLCKLLR; IKVRQLCKL; IYPGIKVRQLCKLLR; YP GIKVRQL; IYQEPFKNLKTGKYA; FKNLKTGKY; KAFSPEVIPMFSAL | |

-continued

| Protein accession no/ name | Antigenic peptides | SEQ ID NO |
|---|---|---|
| | S; EVIPMFSAL; KAFSPEVIPMFSALS; FSPEVIPMF; KAFSPEVIPMFSALS; KAFSPEVIP; KAGYVTNRGRQKVVT; VTNRGRQKV; KAGYVTNRGRQKVVT; YVTNRGRQK; KAIGTVLVGPTPVNI; IGTVLVGPT; KAIGTVLVGPTPVNI; VLVGPTPVN; KALGPAATLEEMMTA; LGPAATLEE; KAREFSSEQTRANSP; FSSEQTRAN; KARVLAEAMSQVTNS; LAEAMSQVT; KCQLKGEAMHGQVDC; LKGEAMHGQ; KEKVYLAWVPAHKGI; LAWVPAHKG; KEKVYLAWVPAHKGI; VYLAWVPAH; KEKVYLAWVPAHKGI; YLAWVPAHK; KELKKIIGQVRDQAE; LKKIIGQVR; KELQKQITKIQNFRV; LQKQITKIQ; KEPIVGAETFYVDGA; IVGAETFYV; KEPPFLWMGYELHPD; FLWMGYELH; KETWETWWTEYWQAT; WETWWTEYW; KGSPAIFQSSMTKIL; IFQSSMTKI; KIEELRQHLLRWGLT; LRQHLLRWG; KIGPENPYNTPVFAI; IGPENPYNT; KILEPFRKQNPDIVI; FRKQNPDIV; KIQNFRVYYRDSRNP; IQNFRVYYR; KISKIGPENPYNTPV; IGPENPYNT; KITTESIVIWGKTPK; ESIVIWGKT; KITTESIVIWGKTPK; SIVIWGKTP; KIVRMYSPTSILDIR; IVRMYSPTS; KIVRMYSPTSILDIR; VRMYSPTSI; KIVRMYSPTSILDIR; YSPTSILDI; KKEKVYLAWVPAHKG; KVYLAWVPA; KKEKVYLAWVPAHKG; VYLAWVPAH; KKEKVYLAWVPAHKG; YLAWVPAHK; KKKYKLKHIVWASRE; LKHIVWASR; KKKYKLKHIVWASRE; YKLKHIVWA; KKSVTVLDVGDAYFS; VTVLDVGDA; KKYKLKHIVWASREL; LKHIVWASR; KKYKLKHIVWASREL; YKLKHIVWA; KLAGRWPVKTIHTDN; LAGRWPVKT; KLGKAGYVTNRGRQK; GYVTNRGRQ; KLGKAGYVTNRGRQK; KAGYVTNRG; KLKHIVWASRELERF; LKHIVWASR; KLLRGTKALTEVIPL; LRGTKALTE; KLLWKGEGAVVIQDN; WKGEGAVVI; KLVDFRELNKRTQDF; FRELNKRTQ; KLVDFRELNKRTQDF; VDFRELNKR; KLVGKLNWASQIYPG; KLNWASQIY; KLVGKLNWASQIYPG; LVGKLNWAS; KLVSAGIRKVLFLDG; LVSAGIRKV; KNLKTGKYARMRGAH; LKTGKYARM; KNWMTETLLVQNANP; WMTETLLVQ; KQEFGIPYNPQSQGV; FGIPYNPQS; KQITKIQNFRVYYRD; IQNFRVYYR; KQITKIQNFRVYYRD; ITKIQNFRV; KQLTEAVQKITTESI; AVQKITTES; KRWIILGLNKIVRMY; ILGLNKIVR; KRWIILGLNKIVRMY; LGLNKIVRM; KRWIILGLNKIVRMY; WIILGLNKI; KSVTVLDVGDAYFSV; LDVGDAYFS; KTAVQMAVFIHNFKR; VQMAVFIHN; KTELQAIYLALQDSG; LQAIYLALQ; KTGKYARMRGAHTND; YARMRGAHT; KTILKALGPAATLEE; ILKALGPAA; KTILKALGPAATLEE; LKALGPAAT; KVILVAVHVASGYIE; LVAVHVASG; KVILVAVHVASGYIE; VILVAVHVA; KVKQWPLTEEKIKAL; VKQWPLTEE; KVRQLCKLLRGTKAL; VRQLCKLLR; KVVTLTDTTNQKTEL; VTLTDTTNQ; KVYLAWVPAHKGIGG; LAWVPAHKG; KVYLAWVPAHKGIGG; VYLAWVPAH; KVYLAWVPAHKGIGG; WPAHKGIG; KVYLAWVPAHKGIGG; YLAWVPAHK; KWRKLVDFRELNKRT; VDFRELNKR; KWTVQPIVLPEKDSW; WTVQPIVLP; KYARMRGAHTNDVKQ; MRGAHTNDV; KYHSNWRAMASDFNL; WRAMASDFN; KYHSNWRAMASDFNL; YHSNWRAMA; KYKLKHIVWASRELE; LKHIVWASR; LAEAMSQVTNSATIM; AMSQVTNSA; LAEAMSQVTNSATIM; LAEAMSQVT; LAENREILKEPVHGV; EILKEPVHG; LAFLQGKAREFSSEQ; FLQGKAREF; LAGRWPVKTIHTDNG; LAGRWPVKT; LAWVPAHKGIGGNEQ; LAWVPAHKG; LCKLLRGTKALTEVI; LRGTKALTE; LDEDFRKYTAFTIPS; FRKYTAFTI; LDVGDAYFSVPLDED; DAYFSVPLD; LEEMMTACQGVGGPG; MTACQGVGG; LEEMSLPGRWKPKMI; LEEMSLPGR; LEGKVILVAVHVASG; KVILVAVHV; LEGKVILVAVHVASG; VILVAVHVA; LEKEPIVGAETFYVD; IVGAETFYV; LEPFRKQNPDIVIYQ; FRKQNPDIV; LERFAVNPGLLETSE; FAVNPGLLE; LERFAVNPGLLETSE; VNPGLLETS; LEVNIVTDSQYALGI; VNIVTDSQY; LGIIQAPDQSESEL; IIQAPDQS; LGIIQAPDQSESEL; IQAPDQSE; LGKAGYVTNRGRQKV; YVTNRGRQK; LGLNKIVRMYSPTSI; IVRMYSPTS; LGLNKIVRMYSPTSI; LGLNKIVRM; LGLNKIVRMYSPTSI; LNKIVRMYS; LGPAATLEEMMTACQ; AATLEEMMT; LGQLQPSLQTGSEEL; LGQLQPSLQ; LHPDKWTVQPIVLPE; WTVQPIVLP; LIEICGHKAIGTVLV; ICGHKAIGT; LIKKEKVYLAWVPAH; KVYLAWVPA; LKALGPAATLEEMMT; LKALGPAAT; LKHIVWASRELERFA; LKHIVWASR; LKKKKSVTVLDVGDA; LKKKKSVTV; LKLAGRWPVKTIHTD; LAGRWPVKT; LKLAGRWPVKTIHTD; LKLAGRWPV; LKTAVQMAVFIHNFK; LKTAVQMAV; LKTAVQMAVFIHNFK; VQMAVFIHN; LKTGKYARMRGAHTN; YARMRGAHT; LLKLAGRWPVKTIHT; LAGRWPVKT; LLKLAGRWPVKTIHT; LKLAGRWPV; LLRWGLTTPDKKHQK; LLRWGLTTPD; LLRWGLTTPDKKHQK; LRWGLTTPD; LLRWGLTTPDKKHQK; WGLTTPDKK; LLVQNANPDCKTILK; VQNANPDCK; LLWKGEGAVVIQDNS; WKGEGAVVI; LNFPISPIETVPVKL; ISPIETVPV; LNKIVRMYSPTSILD; IVRMYSPTS; LNKIVRMYSPTSILD; LNKIVRMYS; LNKIVRMYSPTSILD; VRMYSPTSI; LNTMLNTVGGHQAAM; LNTMLNTVG; LNTMLNTVGGHQAAM; MLNTVGGHQ; LNTVGGHQAAMQMLK; VGGHQAAMQ; LPPVVAKEIVASCDK; VVAKEIVAS; LPQGWKGSPAIFQSS; WKGSPAIFQ; LQAIYLALQDSGLEV; LQAIYLALQ; LQEQIGWMTNNPPIP; IGWMTNNPP; LQKQITKIQNFRVYY; ITKIQNFRV; LQKQITKIQNFRVYY; LQKQITKIQ; LREDLAFLQGKAREF; LAFLQGKAR; LRQHLLRWGLTTPDK; LLRWGLTTP; LRQHLLRWGLTTPD | |

| Protein accession no/ name | Antigenic peptides | SEQ ID NO |
|---|---|---|
| | K; LRWGLTTPD; LRSLYNTVATLYCVH; LYNTVATLY; LRSLYNTVAT LYCVH; YNTVATLYC; LRWGLTTPDKKHQKE; LRWGLTTPD; LRWGL TTPDKKHQKE; WGLTTPDKK; LTEAVQKITTESIVI; VQKITTESI; LTE EKIKALVEICTE; IKALVEICT; LVGKLNWASQIYPGI; KLNWASQIY; LV GKLNWASQIYPGI; LVGKLNWAS; LVGPTPVNIIGRNLL; GPTPVNIIG; LVGPTPVNIIGRNLL; LVGPTPVNI; LVKLWYQLEKEPIVG; VKLWYQ LEK; LVSAGIRKVLFLDGI; LVSAGIRKV; LWKGEGAVVIQDNSD; WK GEGAVVI; LWKGPAKLLWKGEGA; LWKGPAKLL; LWQRPLVTIKIGG QL; LWQRPLVTI; LYNTVATLYCVHQRI; LYNTVATLY; LYNTVATLYC VHQRI; YNTVATLYC; MASDFNLPPVVAKEI; DFNLPPVVA; MASDFN LPPVVAKEI; MASDFNLPP; MAVFIHNFKRKGGIG; FIHNFKRKG; MA VFIHNFKRKGGIG; IHNFKRKGG; MDDLYVGSDLEIGQH; YVGSDLEI G; MDGPKVKQWPLTEEK; VKQWPLTEE; MFSALSEGATPQDLN; MF SALSEGA; MGARASVLSGGELDR; MGARASVLS; MLNTVGGHQAA MQML; MLNTVGGHQ; MLNTVGGHQAAMQML; VGGHQAAMQ; MM QRGNFRNQRKIVK; NFRNQRKIV; MMQRGNFRNQRKIVK; QRGNFR NQR; MMQRGNFRNQRKIVK; RGNFRNQRK; MNKELKKIIGQVRDQ; LKKIIGQVR; MQRGNFRNQRKIVKC; FRNQRKIVK; MRGAHTNDVKQ LTEA; MRGAHTNDV; MSQVTNSATIMMQRG; VTNSATIMM; MTETLL VQNANPDCK; LLVQNANPD; MTETLLVQNANPDCK; MTETLLVQN; MTNNPPIPVGEIYKR; MTNNPPIPV; MVHQAISPRTLNAWV; MVHQAI SPR; MVHQAISPRTLNAWV; VHQAISPRT; NDIQKLVGKLNWASQ; L VGKLNWAS; NEQVDKLVSAGIRKV; VDKLVSAGI; NETPGIRYQYNV LPQ; IRYQYNVLP; NFLREDLAFLQGKAR; FLREDLAFL; NFPISPIETV PVKLK; ISPIETVPV; NFPQVTLWQRPLVTI; TLWQRPLVT; NFRNQRK IVKCFNCG; FRNQRKIVK; NFRVYYRDSRNPLWK; FRVYYRDSR; NF RVYYRDSRNPLWK; YRDSRNPLW; NFRVYYRDSRNPLWK; YYRDS RNPL; NFTGATVRAACWWAG; FTGATVRAA; NGSNFTGATVRAAC W; FTGATVRAA; NIIGRNLLTQIGCTL; GRNLLTQIG; NIIGRNLLTQIG CTL; IGRNLLTQI; NIQGQMVHQAISPRT; IQGQMVHQA; NIQGQMV QAISPRT; MVHQAISPR; NKELKKIIGQVRDQA; LKKIIGQVR; NKIVRM YSPTSILDI; IVRMYSPTS; NKIVRMYSPTSILDI; VRMYSPTSI; NLKTG KYARMRGAHT; GKYARMRGA; NLKTGKYARMRGAHT; LKTGKYAR M; NLKTGKYARMRGAHT; NLKTGKYAR; NLPPVVAKEIVASCD; VVA KEIVAS; NNETPGIRYQYNVLP; NNETPGIRY; NPDCKTILKALGPAA; CKTILKALG; NPDCKTILKALGPAA; KTILKALGP; NPDIVIYQYMDDLY V; IVIYQYMDD; NPLWKGPAKLLWKGE; LWKGPAKLL; NQKTELQAIY LALQD; LQAIYLALQ; NREILKEPVHGVYYD; ILKEPVHGV; NRGRQK VVTLTDGTTN; RQKVVTLTD; NSATIMMQRGNFRNQ; IMMQRGNFR; N SDIKVVPRRKAKII; IKVVPRRKA; NTMLNTVGGHQAAMQ; LNTVGG HQA; NTMLNTVGGHQAAMQ; MLNTVGGHQ; NTPPLVKLWYQLEKE; VKLWYQLEK; NTPVFAIKKKDSTKW; VFAIKKKDS; NTVGGHQAAM QMLKE; VGGHQAAMQ; NVLPQGWKGSPAIFQ; GWKGSPAIF; NVLP QGWKGSPAIFQ; QGWKGSPAI; NWASQIYPGIKVRQL; SQIYPGIKV; NWRAMASDFNLPPVV; MASDFNLPP; NWRAMASDFNLPPVV; WRA MASDFN; NYPIVQNIQGQMVHQ; VQNIQGQMV; PAGLKKKKSVTVL DV; LKKKKSVTV; PAIFQSSMTKILEPF; FQSSMTKIL; PAKLLWKGEG AVVIQ; WKGEGAVVI; PDCKTILKALGPAAT; CKTILKALG; PDCTILK ALGPAAT; ILKALGPAA; PDIVIYQYMDDLYVG; YQYMDDLYV; PDKW TVQPIVLPEKD; WTVQPIVLP; PEVIPMFSALSEGAT; VIPMFSALS; P EWEFVNTPPLVKLW; FVNTPPLVK; PEWEFVNTPPLVKLW; VNTPP LVKL; PEWEFVNTPPLVKLW; WEFVNTPPL; PFKNLKTGKYARMRG; FKNLKTGKY; PFNLKTGKYARMRG; LKTGKYARM; PFRKQNPDIVI YQYM; FRKQNPDIV; PGHKARVLAEAMSQV; ARVLAEAMS; PGIKVR QLCKLLRGT; VRQLCKLLR; PGIRYQYNVLPQGWK; IRYQYNVLP; P GIRYQYNVLPQGWK; YQYNVLPQG; PHPAGLKKKKSVTVL; LKKKK SVTV; PIETVPVKLKPGMDG; TVPVKLKPG; PIQKETWETWWTEYW; KETWETWWT; PISPIETVPVKLKPG; ISPIETVPV; PIVGAETFYVDGA AN; IVGAETFYV; PIVQNIQGQMVHQAI; VQNIQGQMV; PKVKQWPLT EEKIKA; VKQWPLTEE; PLDEDFRKYTAFTIP; FRKYTAFTI; PLTEEKI KALVEICT; LTEEKIKAL; PLVKLWYQLEKEPIV; VKLWYQLEK; PLWK GPAKLLWKGEG; LWKGPAKLL; PMFSALSEGATPQDL; MFSALSEG A; PPFLWMGYELHPDKW; FLWMGYELH; PPLVKLWYQLEKEPI; VKL WYQLEK; PPVVAKEIVASCDKC; VVAKEIVAS; PQDNLNTMLNTVGGH Q; DLNTMLNTV; PQDLNTMLNTVGGHQ; LNTMLNTVG; PQGWKGSP AIFQSSM; WKGSPAIFQ; PQVTLWQRPLVTIKI; LWQRPLVTI; PQVTL WQRPLVTIKI; TLWQRPLVT; PRGSDIAGTTSTLQE; IAGTTSTLQ; PR TLNAWVKVVEEKA; LNAWVKVVE; PRTLNAWVKVVEEKA; TLNAWV KVV; PSINNETPGIRYQYN; INNETPGIR; PTPVNIIGRNLLTQI; IIGRNL LTQ; PTPVNIIGRNLLTQI; VNIIGRNLL; PVFAIKKKDSTKWRK; IKKKD STKW; PVGEIYKRWIILGLN; YKRWIILGL; PVHAGPIAPGQMREP; VH AGPIAPG; PVKLKPGMDGPKVKQ; VKLKPGMDG; PVNIIGRNLLTQI GC; GRNLLTQIG; PVNIIGRNLLTQIGC; VNIIGRNLL; PVVAKEIVASC DKCQ; VVAKEIVAS; PAATLEEMMTACQGV; LEEMMTACQ; QAEHLK TAVQMAVFI; LKTAVQMAV; QAISPRTLNAWVKVV; ISPRTLNAW; QA | |

| Protein accession no/ name | Antigenic peptides | SEQ ID NO |
|---|---|---|
| | IYLALQDSGLEVN; YLALQDSGL; QASQEVKNWMTETLL; VKNWMTETL; QATWIPEWEFVNTPP; ATWIPEWEF; QDEHEKYHSNWRAMA; KYHSNWRAM; QDFWEVQLGIPHPAG; VQLGIPHPA; QDLNTMLNTVGGHQA; LNTMLNTVG; QDLNTMLNTVGGHQA; MLNTVGGHQ; QDNSDIKVVPRRKAK; IKVVPRRKA; QDSGLEVNIVTDSQY; LEVNIVTDS; QEFGIPYNPQSQGVV; PYNPQSQGV; QEPFKNLKTGKYARM; FKNLKTGKY; QEQIGWMTNNPPIPV; IGWMTNNPP; QETAYFLLKLAGRWP; FLLKLAGRW; QETAYFLLKLAGRWP; YFLLKLAGR; QEVKNWMTETLLVQN; VKNWMTETL; QGKAREFSSEQTRAN; AREFSSEQT; QGQMVHQAISPRTLN; MVHQAISPR; QGQMVHQAISPRTLN; VHQAISPRT; QGTVSFNFPQVTLWQ; VSFNFPQVT; QGWKGSPAIFQSSMT; WKGSPAIFQ; QHLLRWGLTTPDKKH; LLRWGLTTP; QHLLRWGLTTPDKKH; LRWGLTTPD; QHLLRWGLTTPDKKH; WGLTTPDKK; QIGWMTNNPPIPVGE; IGWMTNNPP; MTNNPPIPV; QIGWMTNNPPIPVGE; WMTNNPPIP; QIIEQLIKKEKVYLA; LIKKEKVYL; QILGQLQPSLQTGSE; GQLQPSLQT; QILGQLQPSLQTGSE; LGQLQPSLQ; QILIEICGHKAIGTV; ICGHKAIGT; QITKIQNFRVYYRDS; IQNFRVYYR; QITKIQNFRVYYRDS; ITKIQNFRV; QIYPGIKVRQLCKLL; YPGIKVRQL; QIYQEPFKNLKTGKY; IYQEPFKNL; QIYQEPFKNLKTGKY; PFKNLKTGK; QIYQEPFKNLKTGKY; YQEPFKNLK; QKEPPFLWMGYELHP; FLWMGYELH; QKETWETWWTEYWQA; WETWWTEYW; QKLVGKLNWASQIYP; KLNWASQIY; QKLVGKLNWASQIYP; LVGKLNWAS; QKQITKIQNFRVYYR; ITKIQNFRV; QKQITKIQNFRVYYR; TKIQNFRVY; QKTELQAIYLALQDS; LQAIYLALQ; QKVVTLTDTTNQKTE; LTDTTNQKT; QKVVTLTDTTNQKTE; VTLTDTTNQ; QLCKLLRGTKALTEV; LRGTKALTE; QLEKEPIVGAETFYV; LEKEPIVGA; QLIKKEKVYLAWVPA; IKKEKVYLA; QLTEAVQKITTESIV; VQKITTESI; QMAVFIHNFKRKGGI; FIHNFKRKG; QMAVFIHNFKRKGGI; VFIHNFKRK; QMVHQAISPRTLNAW; MVHQAISPR; QMVHQAISPRTLNAW; VHQAISPRT; QNFRVYYRDSRNPLW; FRVYYRDSR; QNFRVYYRDSRNPLW; YYRDSRNPL; QNIQGQMVHQAISPR; IQGQMVHQA; QNYPIVQNIQGQMVH; VQNIQGQMV; QRGNFRNQRKIVKCF; FRNQRKIVK; QSESELVNQIIEQLI; LVNQIIEQL; QSSMTKILEPFRKQN; TKILEPFRK; QTGSEELRSLYNTVA; SEELRSLYN; QTKELQKQITKIQNF; LQKQITKIQ; QVDKLVSAGIRKVLF; LVSAGIRKV; QVTLWQRPLVTIKIG; LWQRPLVTI; QVTLWQRPLVTIKIG; TLWQRPLVT; QVTNSATIMMQRGNF; VTNSATIMM; QYALGIIQAQPDQSE; IIQAQPDQS; QYALGIIQAQPDQSE; LGIIQAQPD; QYMDDLYVGSDLEIG; LYVGSDLEI; RAMASDFNLPPVVAK; DFNLPPVVA; RAMASDFNLPPVVAK; MASDFNLPP; RDQAEHLKTAVQMAV; HLKTAVQMA; RDSRNPLWKGPAKLL; PLWKGPAKL; RDYVDRFYKTLRAEQ; DRFYKTLRA; RDYVDRFYKTLRAEQ; DYVDRFYKT; RDYVDRFYKTLRAEQ; VDRFYKTLR; REDLAFLQGKAREFS; FLQGKAREF; REDLAFLQGKAREFS; LAFLQGKAR; REFSSEQTRANSPTR; FSSEQTRAN; RELERFAVNPGLLET; FAVNPGLLE; RELERFAVNPGLLET; LERFAVNPG; RELQVWGRDNNSPSE; WGRDNNSPS; RFAVNPGLLETSEGC; FAVNPGLLE; RFAVNPGLLETSEGC; VNPGLLETS; RFYKTLRAEQASQEV; FYKTLRAEQ; RFYKTLRAEQASQEV; YKTLRAEQA; RGNFRNQRKIVKCFN; FRNQRKIVK; RGRQKVVTLTDTTNQ; KVVTLTDTT; RGRQKVVTLTDTTNQ; RQKVVTLTD; RGRQKVVTLTDTTNQ; VVTLTDTTN; RGSDIAGTTSTLQEQ; IAGTTSTLQ; RKLVDFRELNKRTQD; FRELNKRTQ; RKLVDFRELNKRTQD; VDFRELNKR; RKYTAFTIPSINNET; YTAFTIPSI; RMRGAHTNDVKQLTE; MRGAHTNDV; RMYSPTSILDIRQGP; YSPTSILDI; RNPLWKGPAKLLWKG; LWKGPAKLL; RQGTVSFNFPQVTLW; VSFNFPQVT; RQHLLRWGLTTPDKK; LLRWGLTTP; RQHLLRWGLTTPDKK; LRWGLTTPD; RQHLLRWGLTTPDKK; RWGLTTPDK; RQILGQLQPSLQTGS; GQLQPSLQT; RQILGQLQPSLQTGS; LGQLQPSLQ; RQKVVTLTDTTNQKT; VTLTDTTNQ; RQKVVTLTDTTNQKT; VVTLTDTTN; RQLCKLLRGTKALTE; CKLLRGTKA; RRELQVWGRDNNSPS; LQVWGRDNN; RSLYNTVATLYCVHQ; LYNTVATLY; RSLYNTVATLYCVHQ; YNTVATLYC; RTKIEELRQHLLRWG; ELRQHLLRW; RTKIEELRQHLLRWG; IEELRQHLL; RTLNAWVKVVEEKAF; LNAWVKVVE; RTLNAWVKVVEEKAF; TLNAWVKVV; RVHPVHAGPIAPGQM; VHAGPIAPG; RVLAEAMSQVTNSAT; AMSQVTNSA; RVLAEAMSQVTNSAT; LAEAMSQVT; RVYYRDSRNPLWKGP; YRDSRNPLW; RVYYRDSRNPLWKGP; YYRDSRNPL; RWGLTTPDKKHQKEP; WGLTTPDKK; RWIILGLNKIVRMYS; ILGLNKIVR; RWIILGLNKIVRMYS; LGLNKIVRM; RWIILGLNKIVRMYS; WIILGLNKI; RWPVKTIHTDNGSNF; VKTIHTDNG; SAGERIVDIIATDIQ; IVDIIATDI; SATIMMQRGNFRNQR; IMMQRGNFR; SCDKCQLKGEAMHGQ; QLKGEAMHG; SDFNLPPVVAKEIVA; FNLPPVVAK; SDIAGTTSTLQEQIG; IAGTTSTLQ; SDIKVVPRRKAKIIR; IKVVPRRKA; SDIKVVPRRKAKIIR; VVPRRKAKI; SEELRSLYNTVATLY; LRSLYNTVA; SELVNQIIEQLIKKE; LVNQIIEQL; SESELVNQIIEQLIK; LVNQIIEQL; SGLEVNIVTDSQYAL; LEVNIVTDS; SINNETPGIRYQYNV; INNETPGIR; SIVIWGKTPKFKLPI; IVIWGKTPK; SIVIWGKTPKFKLPI; IWGKTPKFK; SIVIWGKTPKFKLPI; VIW | |

-continued

| Protein accession no/ name | Antigenic peptides | SEQ ID NO |
|---|---|---|
| | GKTPKF; SKIGPENPYNTPVFA; IGPENPYNT; SLYNTVATLYCVHQR; LYNTVATLY; SLYNTVATLYCVHQR; YNTVATLYC; SMNKELKKIIGQ VRD; LKKIIGQVR; SMTKILEPFRKQNPD; TKILEPFRK; SNFTGATVR AACWWA; FTGATVRAA; SNWRAMASDFNLPPV; MASDFNLPP; SN WRAMASDFNLPPV; WRAMASDFN; SPAIFQSSMTKILEP; FQSSMT KIL; SPEVIPMFSALSEGA; VIPMFSALS; SPRTLNAWVKVVEEK; LNA WVKVVE; SPRTLNAWVKVVEEK; TLNAWVKVV; SQEVKNWMTETL LVQ; VKNWMTETL; SQIYPGIKVRQLCKL; YPGIKVRQL; SQNYPIVQ NIQGQMV; IVQNIQGQM; SQNYPIVQNIQGQMV; SQNYPIVQN; SQV TNSATIMMQRGN; VTNSATIMM; SQYALGIIQAQPDQS; LGIIQAQPD; SQYALGIIQAQPDQS; YALGIIQAQ; SRELERFAVNPGLLE; LERFAV NPG; SRNPLWKGPAKLLWK; LWKGPAKLL; SSEQTRANSPTRREL; QTRANSPTR; SSMTKILEPFRKQNP; TKILEPFRK; STLQEQIGWMT NNPP; LQEQIGWMT; STLQEQIGWMTNNPP; QIGWMTNNP; SWTVN DIQKLVGKLN; VNDIQKLVG; TAVQMAVFIHNFKRK; VQMAVFIHN; T AYFLLKLAGRWPVK; FLLKLAGRW; TAYFLLKLAGRWPVK; LKLAGR WPV; TAYFLLKLAGRWPVK; YFLLKLAGR; TDIQTKELQKQITKI; IQT KELQKQ; TDNGSNFTGATVRAA; NFTGATVRA; TDSQYALGIIQAQP D; YALGIIQAQ; TEAVQKITTESIVIW; VQKITTESI; TEEKIKALVEICTE M; IKALVEICT; TELQAIYLALQDSGL; LQAIYLALQ; TESIVIWGKTPKF KL; IVIWGKTPK; TESIVIWGKTPKFKL; IWGKTPKFK; TESIVIWGKTP KFKL; VIWGKTPKF; TETLLVQNANPDCKT; VQNANPDCK; TEYWQA TWIPEWEFV; WQATWIPEW; TFYVDGAANRETKLG; YVDGAANRE; TGATVRAACWWAGIK; VRAACWWAG; TGKYARMRGAHTNDV; YA RMRGAHT; TGQETAYFLLKLAGR; TAYFLLKLA; TGSEELRSLYNTV AT; LRSLYNTVA; THLEGKVILVAVHVA; KVILVAVHV; TILKALGPAAT LEEM; LKALGPAAT; TIMMQRGNFRNQRKI; IMMQRGNFR; TIPSINN ETPGIRYQ; INNETPGIR; TKELQKQITKIQNFR; LQKQITKIQ; TKIEEL RQHLLRWGL; LRQHLLRWG; TKILEPFRKQNPDIV; TKILEPFRK; TKI QNFRVYYRDSRN; IQNFRVYYR; TKWRKLVDFRELNKR; WRKLVDF RE; TLEEMMTACQGVGGP; MTACQGVGG; TLLVQNANPDCKTIL; V QNANPDCK; TLNAWVKVVEEKAFS; LNAWVKVVE; TLNFPISPIETV PVK; ISPIETVPV; TLQEQIGWMTNNPPI; IGWMTNNPP; TLWQRPLV TIKIGGQ; LWQRPLVTI; TMLNTVGGHQAAMQM; MLNTVGGHQ; TML NTVGGHQAAMQM; VGGHQAAMQ; TNQKTELQAIYLALQ; KTELQAI YL; TNSATIMMQRGNFRN; IMMQRGNFR; TPGIRYQYNVLPQGW; IR YQYNVLP; TPGIRYQYNVLPQGW; YQYNVLPQG; TPPLVKLWYQLE KEP; VKLWYQLEK; TPQDLNTMLNTVGGH; LNTMLNTVG; TPVFAIK KKDSTKWR; IKKKDSTKW; TPVFAIKKKDSTKWR; VFAIKKKDS; TPV NIIGRNLLTQIG; IGRNLLTQI; TPVNIIGRNLLTQIG; VNIIGRNLL; TQD FWEVQLGIPHPA; EVQLGIPHP; TSTLQEQIGWMTNNP; LQEQIGW MT; TTESIVIWGKTPKFK; IVIWGKTPK; TTESIVIWGKTPKFK; VIWGK TPKF; TTSTLQEQIGWMTNN; LQEQIGWMT; TVGGHQAAMQMLKET; VGGHQAAMQ; TVLDVGDAYFSVPLD; LDVGDAYFS; TVLEEMSLP GRWKPK; LEEMSLPGR; TVLVGPTPVNIIGRN; LVGPTPVNI; TVNDI QKLVGKLNWA; IQKLVGKLN; TVPVKLKPGMDGPKV; VKLKPGMDG; TVRAACWWAGIKQEF; VRAACWWAG; TWETWWTEYWQATWI; W ETWWTEYW; TWIPEWEFVNTPPLV; WEFVNTPPL; TWWTEYWQAT WIPEW; EYWQATWIP; VDGAANRETKLGKAG; VDGAANRET; VDKL VSAGIRKVLFL; LVSAGIRKV; VDRFYKTLRAEQASQ; DRFYKTLRA; V DRFYKTLRAEQASQ; FYKTLRAEQ; VDRFYKTLRAEQASQ; YKTLRA EQA; VFAIKKKDSTKWRKL; IKKKDSTKW; VFIHNFKRKGGIGGY; FK RKGGIGG; VFIHNFKRKGGIGGY; IHNFKRKGG; VGAETFYVDGAAN RE; FYVDGAANR; VGDAYFSVPLDEDFR; YFSVPLDED; VGEIYKRW IILGLNK; YKRWIILGL; VGGHQAAMQMLKETI; VGGHQAAMQ; VGKL NWASQIYPGIK; KLNWASQIY; VGPTPVNIIGRNLLT; VNIIGRNLL; VH AGPIAPGQMREPR; VHAGPIAPG; VHPVHAGPIAPGQMR; VHAGPIA PG; VHQAISPRTLNAWVK; VHQAISPRT; VILVAVHVASGYIEA; LVAV HVASG; VIPMFSALSEGATPQ; MFSALSEGA; VIPMFSALSEGATPQ; VIPMFSALS; VIYQYMDDLYVGSDL; YQYMDDLYV; VKLKPGMDGPK VKQW; VKLKPGMDG; VKLWYQLEKEPIVGA; VKLWYQLEK; VKNWM TETLLVQNAN; NWMTETLLV; VKNWMTETLLVQNAN; WMTETLLVQ; VKQWPLTEEKIKALV; VKQWPLTEE; VLAEAMSQVTNSATI; AMSQV TNSA; VLAEAMSQVTNSATI; LAEAMSQVT; VLEEMSLPGRWKPKM; LEEMSLPGR; VLPQGWKGSPAIFQS; WKGSPAIFQ; VLVGPTPVNII GRNL; LVGPTPVNI; VNDIQKLVGKLNWAS; IQKLVGKLN; VNDIQKLV GKLNWAS; KLVGKLNWA; VNIIGRNLLTQIGCT; GRNLLTQIG; VNIIG RNLLTQIGCT; VNIIGRNLL; VNTPPLVKLWYQLEK; LVKLWYQLE; VN TPPLVKLWYQLEK; VNTPPLVKL; VPLDEDFRKYTAFTI; DFRKYTAF T; VPVKLKPGMDGPKVK; VKLKPGMDG; VQKITTESIVIWGKT; VQKI TTESI; VQLGIPHPAGLKKKK; VQLGIPHPA; VQMAVFIHNFKRKGG; F IHNFKRKG; VQMAVFIHNFKRKGG; MAVFIHNFK; VQMAVFIHNFKR KGG; VFIHNFKRK; VQNIQGQMVHQAISP; IQGQMVHQA; VRMYSPT SILDIRQG; MYSPTSILD; VRMYSPTSILDIRQG; VRMYSPTSI; VRMY SPTSILDIRQG; YSPTSILDI; VRQLCKLLRGTKALT; CKLLRGTKA; VR | |

| Protein accession no/ name | Antigenic peptides | SEQ ID NO |
|---|---|---|
| | QLCKLLRGTKALT; VRQLCKLLR; VRAACWWAGIKQEFG; VRAACW WAG; VTDSQYALGIIQAQP; YALGIIQAQ; VTLWQRPLVTIKIGG; LWQ RPLVTI; VTNRGRQKVVTLTDT; VTNRGRQKV; VTNSATIMMQRGNF R; SATIMMQRG; VTNSATIMMQRGNFR; VTNSATIMM; VTVLDVGDA YFSVPL; LDVGDAYFS; VVAKEIVASCDKCQL; VVAKEIVAS; VYLAW VPAHKGIGGN; LAWVPAHKG; VYLAWVPAHKGIGGN; WVPAHKGIG; VYLAWVPAHKGIGGN; YLAWVPAHK; VYYRDSRNPLWKGPA; YRD SRNPLW; WASQIYPGIKVRQLC; YPGIKVRQL; WDRVHPVHAGPIAP G; VHPVHAGPI; WEFVNTPPLVKLWYQ; FVNTPPLVK; WEFVNTPPL VKLWYQ; VNTPPLVKL; WEFVNTPPLVKLWYQ; WEFVNTPPL; WET WWTEYWQATWIP; WETWWTEYW; WETWWTEYWQATWIP; WWT EYWQAT; WEVQLGIPHPAGLKK; VQLGIPHPA; WIILGLNKIVRMYSP; ILGLNKIVR; WIILGLNKIVRMYSP; LGLNKIVRM; WIILGLNKIVRMYS P; LNKIVRMYS; WIILGLNKIVRMYSP; WIILGLNKI; WIPEWEFVNTPP LVK; EFVNTPPLV; WIPEWEFVNTPPLVK; WEFVNTPPL; WKGEGAV VIQDNSDI; WKGEGAVVI; WKGSPAIFQSSMTKI; WKGSPAIFQ; WMT NNPPIPVGEIYK; MTNNPPIPV; WPVKTIHTDNGSNFT; VKTIHTDNG; WQATWIPEWEFVNTP; ATWIPEWEF; WRAMASDFNLPPVVA; MAS DFNLPP; WRAMASDFNLPPVVA; WRAMASDFN; WRKLVDFRELNK RTQ; VDFRELNKR; WTEYWQATWIPEWEF; WQATWIPEW; WTVNDI QKLVGKLNW; IQKLVGKLN; WTVQPIVLPEKDSWT; WTVQPIVLP; W WTEYWQATWIPEWE; EYWQATWIP; YALGIIQAQPDQSES; IIQAQP DQS; YALGIIQAQPDQSES; IQAQPDQSE; YARMRGAHTNDVKQL; M RGAHTNDV; YFLLKLAGRWPVKTI; LAGRWPVKT; YFLLKLAGRWPV KTI; LKLAGRWPV; YFLLKLAGRWPVKTI; YFLLKLAGR; YHSNWRAM ASDFNLP; WRAMASDFN; YIEAEVIPAETGQET; AEVIPAETG; YKLK HIVWASRELER; LKHIVWASR; YKRWIILGLNKIVRM; ILGLNKIVR; YK RWIILGLNKIVRM; WIILGLNKI; YKTLRAEQASQEVKN; YKTLRAEQA; YLALQDSGLEVNIVT; LQDSGLEVN; YLAWVPAHKGIGGNE; LAWVP AHKG; YLAWVPAHKGIGGNE; YLAWVPAHK; YMDDLYVGSDLEIGQ; YVGSDLEIG; YNTVATLYCVHQRIE; YNTVATLYC; YPGIKVRQLCKL LRG; VRQLCKLLR; YPGIKVRQLCKLLRG; YPGIKVRQL; YPIVQNIQG QMVHQA; VQNIQGQMV; YQEPFKNLKTGKYAR; FKNLKTGKY; YSA GERIVDIIATDI; ERIVDIIAT; YVDGAANRETKLGKA; YVDGAANRE; Y VDRFYKTLRAEQAS; DRFYKTLRA; YVDRFYKTLRAEQAS; FYKTLR AEQ; YVDRFYKTLRAEQAS; YKTLRAEQA; YWQATWIPEWEFVNT; A TWIPEWEF; AATLEEMMTACQGVG; LEEMMTACQ | |
| NP_057850 Pr55(Gag) | 8-mers: MGARASVL; SVLSGGEL; ELDRWEKI; RWEKIRLR; RLRPGGKK; KLK HIVWA; IVWASREL; WASRELER; RELERFAV; FAVNPGLL; SEGCRQ IL; QLQPSLQT; LQTGSEEL; QTGSEELR; SLYNTVAT; LYNTVATL; YN TVATLY; TVATLYCV; TLYCVHQR; LYCVHQRI; DTKEALDK; KIEEEQ NK; DTGHSNQV; QVSQNYPI; NYPIVQNI; YPIVQNIQ; GQMVHQAI; SP RTLNAW; RTLNAWVK; TLNAWVKV; WVKVVEEK; KVVEEKAF; EKAF SPEV; FSPEVIPM; SPEVIPMF; EVIPMFSA; VIPMFSAL; IPMFSALS; F SALSEGA; ALSEGATP; TPQDLNTM; NTVGGHQA; TVGGHQAA; HQA AMQML; QAAMQMLK; MQMLKETI; ETINEEAA; EEAAEWDR; EAAEW DRV; EWDRVHPV; HPVHAGPI; GPIAPGQM; WMTNNPPI; TNNPPIPV; PPIPVGEI; PIPVGEIY; GEIYKRWI; EIYKRWII; IYKRWIIL; KRWIILGL; WIILGLNK; IILGLNKI; ILGLNKIV; LGLNKIVR; GLNKIVRM; IVRMYSPT; RMYSPTSI; MYSPTSIL; SPTSILDI; RQGPKEPF; DYVDRFYK; YVDRF YKT; DRFYKTLR; AEQASQEV; EQASQEVK; ASQEVKNW; EVKNWM TE; NWMTETLL; WMTETLLV; ETLLVQNA; NPDCKTIL; ILKALGPA; AL GPAATL; TLEEMMTA; EEMMTACQ; MMTACQGV; GVGGPGHK; VLA EAMSQ; AEAMSQVT; SQVTNSAT; VTNSATIM; SATIMMQR; IMMQR GNF; MMQRGNFR; RGNFRNQR; RNQRKIVK; HTARNCRA; RNCRAP RK; NCRAPRKK; APRKKGCW; QMKDCTER; CTERQANF; TERQANF L; RQANFLGK; FLGKIWPS; KGRPGNFL; TAPPEESF; EESFRSGV; ET TTPPQK; QEPIDKEL; EPIDKELY; ELYPLTSL; LYPLTSLR; PLTSLRSL; SLFGNDPS<br>9-mers: VLSGGELDR; LSGGELDRW; DRWEKIRLR; KIRLRPGGK; RLRPGGK KK; GGKKKYKLK; KKYKLKHIV; KYKLKHIVW; KLKHIVWAS; HIVWAS REL; WASRELERF; ERFAVNPGL; RFAVNPGLL; AVNPGLLET; GLLE TSEGC; ETSEGCRQI; ILGQLQPSL; GQLQPSLQT; SLQTGSEEL; LQT GSEELR; GSEELRSLY; ELRSLYNTV; SLYNTVATL; LYNTVATLY; NT VATLYCV; ATLYCVHQR; TLYCVHQRI; YCVHQRIEI; CVHQRIEIK; QR IEIKDTK; EIKDTKEAL; ALDKIEEEQ; QQAAADTGH; HSNQVSQNY; N QVSQNYPI; QVSQNYPIV; QNYPIVQNI; VQNIQGQMV; IQGQMVHQA; MVHQAISPR; HQAISPRTL; AISPRTLNA; ISPRTLNAW; SPRTLNAW V; RTLNAWVKV; TLNAWVKVV; AWVKVVEEK; EEKAFSPEV; EKAFS PEVI; FSPEVIPMF; EVIPMFSAL; IPMFSALSE; ALSEGATPQ; SEGAT PQDL; ATPQDLNTM; TPQDLNTML; DLNTMLNTV; NTVGGHQAA; TV GGHQAAM; HQAAMQMLK; AMQMLKETI; ETINEEAAE; TINEEAAEW; | 3716-4962 |

| Protein accession no/ name | Antigenic peptides | SEQ ID NO |
|---|---|---|
| | EEAAEWDRV; EAAEWDRVH; AEWDRVHPV; RVHPVHAGP; HPVHA GPIA; DIAGTTSTL; TTSTLQEQI; STLQEQIGW; TLQEQIGWM; GWMT NNPPI; MTNNPPIPV; NPPIPVGEI; PPIPVGEIY; IPVGEIYKR; GEIYKR WII; EIYKRWIIL; YKRWIILGL; RWIILGLNK; WIILGLNKI; IILGLNKIV; GL NKIVRMY; KIVRMYSPT; IVRMYSPTS; RMYSPTSIL; SPTSILDIR; SIL DIRQGP; ILDIRQGPK; RQGPKEPFR; EPFRDYVDR; PFRDYVDRF; R DYVDRFYK; DYVDRFYKT; YVDRFYKTL; VDRFYKTLR; RAEQASQE V; QASQEVKNW; EVKNWMTET; NWMTETLLV; WMTETLLVQ; VQNA NPDCK; TILKALGPA; ILKALGPAA; KALGPAATL; GPAATLEEM; ATLE EMMTA; TLEEMMTAC; EEMMTACQG; EMMTACQGV; GVGGPGHK A; GGPGHKARV; GPGHKARVL; KARVLAEAM; VLAEAMSQV; LAEAM SQVT; AEAMSQVTN; AMSQVTNSA; SQVTNSATI; QVTNSATIM; VTN SATIMM; NSATIMMQR; IMMQRGNFR; MMQRGNFRN; RGNFRNQR K; FRNQRKIVK; NQRKIVKCF; IVKCFNCGK; EGHTARNCR; TARNCR APR; ARNCRAPRK; RNCRAPRKK; APRKKGCWK; HQMKDCTER; R QANFLGKI; QANFLGKIW; FLGKIWPSY; KIWPSYKGR; WPSYKGRP G; SYKGRPGNF; KGRPGNFLQ; FLQSRPEPT; PTAPPEESF; TAPPE ESFR; TPPQKQEPI; PIDKELYPL; KELYPLTSL; ELYPLTSLR; YPLTSL RSL; SLFGNDPSS
10-mers:
RASVLSGGEL; SVLSGGELDR; VLSGGELDRW; ELDRWEKIRL; KIRL RPGGKK; RLRPGGKKKY; RPGGKKKYKL; KKYKLKHIVW; KLKHIVW ASR; IVWASRELER; VWASRELERF; LERFAVNPGL; ERFAVNPGLL; FAVNPGLLET; ETSEGCRQIL; RQILGQLQPS; QILGQLQPSL; ILGQL QPSLQ; SLQTGSEELR; EELRSLYNTV; RSLYNTVATL; SLYNTVATL Y; VATLYCVHQR; ATLYCVHQRI; LYCVHQRIEI; IEIKDTKEAL; AADT GHSNQV; NQVSQNYPIV; SQNYPIVQNI; PIVQNIQGQM; IVQNIQGQ MV; VQNIQGQMVH; NIQGQMVHQA; IQGQMVHQAI; QMVHQAISPR; AISPRTLNAW; RTLNAWVKVV; NAWVKVVEEK; WVKVVEEKAF; VEE KAFSPEV; EEKAFSPEVI; KAFSPEVIPM; AFSPEVIPMF; PEVIPMFSA L; EVIPMFSALS; PMFSALSEGA; ATPQDLNTML; MLNTVGGHQA; NT VGGHQAAM; GHQAAMQMLK; AAMQMLKETI; MLKETINEEA; ETINE EAAEW; AAEWDRVHPV; RVHPVHAGPI; HPVHAGPIAP; IAPGQMRE PR; TSTLQEQIGW; STLQEQIGWM; TLQEQIGWMT; WMTNNPPIPV; NPPIPVGEIY; IPVGEIYKRW; GEIYKRWIIL; IYKRWIILGL; KRWIILGL NK; RWIILGLNKI; WIILGLNKIV; IILGLNKIVR; ILGLNKIVRM; IVRMYSP TSI; MYSPTSILDI; YSPTSILDIR; SILDIRQGPK; DIRQGPKEPF; EPFR DYVDRF; DYVDRFYKTL; YVDRFYKTLR; RFYKTLRAEQ; RAEQASQ EVK; EVKNWMTETL; WMTETLLVQN; LVQNANPDCK; KTILKALGPA; TILKALGPAA; ILKALGPAAT; GPAATLEEMM; ATLEEMMTAC; TLEE MMTACQ; EEMMTACQGV; VGGPGHKARV; RVLAEAMSQV; VLAEA MSQVT; AEAMSQVTNS; EAMSQVTNSA; AMSQVTNSAT; SQVTNSA TIM; QVTNSATIMM; TNSATIMMQR; ATIMMQRGNF; TIMMQRGNFR; MMQRGNFRNQ; MQRGNFRNQR; NFRNQRKIVK; KIVKCFNCGK; KE GHTARNCR; HTARNCRAPR; TARNCRAPRK; ARNCRAPRKK; RAPR KKGCWK; APRKKGCWKC; RKKGCWKCGK; KCGKEGHQMK; QMKD CTERQA; TERQANFLGK; RQANFLGKIW; FLGKIWPSYK; SYKGRPG NFL; FLQSRPEPTA; EPTAPPEESF; PTAPPEESFR; EESFRSGVET; GVETTTPPQK; TTPPQKQEPI; EPIDKELYPL; ELYPLTSLRS; LYPLTS LRSL; YPLTSLRSLF; SLFGNDPSSQ
11-mers:
VLSGGELDRWE; LSGGELDRWEK; GELDRWEKIRL; ELDRWEKIRL R; KIRLRPGGKKK; RLRPGGKKKYK; HIVWASRELER; WASRELERF AV; ELERFAVNPGL; LERFAVNPGLL; GLLETSEGCRQ; LLETSEGCR QI; LETSEGCRQIL; SEGCRQILGQL; RQILGQLQPSL; ILGQLQPSLQ T; QPSLQTGSEEL; LQTGSEELRSL; QTGSEELRSLY; SEELRSLYNT V; RSLYNTVATLY; SLYNTVATLYC; LYNTVATLYCV; NTVATLYCVH Q; TVATLYCVHQR; TLYCVHQRIEI; LYCVHQRIEIK; EIKDTKEALDK; ALDKIEEEQNK; AAADTGHSNQV; HSNQVSQNYPI; YPIVQNIQGQM; PIVQNIQGQMV; NIQGQMVHQAI; GQMVHQAISPR; MVHQAISPRTL; QAISPRTLNAW; AISPRTLNAWV; ISPRTLNAWVK; SPRTLNAWVKV; LNAWVKVVEEK; AWVKVVEEKAF; VVEEKAFSPEV; KAFSPEVIPMF; FSPEVIPMFSA; SPEVIPMFSAL; EVIPMFSALSE; IPMFSALSEGA; A LSEGATPQDL; EGATPQDLNTM; PQDLNTMLNTV; TMLNTVGGHQA; MLNTVGGHQAA; TVGGHQAAMQM; GGHQAAMQMLK; QAAMQML KETI; MQMLKETINEE; QMLKETINEEA; MLKETINEEAA; TINEEAAE WDR; EAAEWDRVHPV; RVHPVHAGPIA; HPVHAGPIAPG; HAGPIAP GQMR; TTSTLQEQIGW; QIGWMTNNPPI; IPVGEIYKRWI; EIYKRWII LGL; KRWIILGLNKI; WIILGLNKIVR; IILGLNKIVRM; KIVRMYSPTSI; IV RMYSPTSIL; RMYSPTSILDI; MYSPTSILDIR; TSILDIRQGPK; DIRQG PKEPFR; RQGPKEPFRDY; QGPKEPFRDYV; EPFRDYVDRFY; PFR DYVDRFYK; DYVDRFYKTLR; YVDRFYKTLRA; TLRAEQASQEV; AE QASQEVKNW; QEVKNWMTETL; EVKNWMTETLL; WMTETLLVQNA; LLVQNANPDCK; NANPDCKTILK; NPDCKTILKAL; KTILKALGPAA; IL KALGPAATL; ALGPAATLEEM; EEMMTACQGVG; MTACQGVGGPG; | |

-continued

| Protein accession no/ name | Antigenic peptides | SEQ ID NO |
|---|---|---|
| | ACQGVGGPGHK; GVGGPGHKARV; KARVLAEAMSQ; AEAMSQVT NSA; EAMSQVTNSAT; AMSQVTNSATI; MSQVTNSATIM; SQVTNSA TIMM; VTNSATIMMQR; ATIMMQRGNFR; MMQRGNFRNQR; MQRG NFRNQRK; FRNQRKIVKCF; HTARNCRAPRK; TARNCRAPRKK; EG HQMKDCTER; CTERQANFLGK; TERQANFLGKI; NFLGKIWPSYK; W PSYKGRPGNF; KGRPGNFLQSR; EPTAPPEESFR; RSGVETTTPPQ; SGVETTTPPQK; TTTPPQKQEPI; QEPIDKELYPL; EPIDKELYPLT; D KELYPLTSLR; ELYPLTSLRSL; LYPLTSLRSLF<br>15-mer + 9-mer core:<br>AEAMSQVTNSATIMM; AMSQVTNSA; AEAMSQVTNSATIMM; MSQV TNSAT; AEAMSQVTNSATIMM; QVTNSATIM; AFSPEVIPMFSALSE; VIPMFSALS; AGPIAPGQMREPRGS; IAPGQMREP; AISPRTLNAWV KVVE; PRTLNAWVK; AISPRTLNAWVKVVE; TLNAWVKVV; AMSQVT NSATIMMQR; AMSQVTNSA; AMSQVTNSATIMMQR; VTNSATIMM; A NFLGKIWPSYKGRP; FLGKIWPSY; ANFLGKIWPSYKGRP; GKIWPS YKG; ANFLGKIWPSYKGRP; LGKIWPSYK; APPEESFRSGVETTT; SF RSGVETT; ARVLAEAMSQVTNSA; LAEAMSQVT; ARVLAEAMSQVT NSA; VLAEAMSQV; ASQEVKNWMTETLLV; VKNWMTETL; ASRELE RFAVNPGLL; LERFAVNPG; ATIMMQRGNFRNQRK; IMMQRGNFR; ATLEEMMTACQGVGG; LEEMMTACQ; ATPQDLNTMLNTVGG; LNT MLNTVG; CKTILKALGPAATLE; ILKALGPAA; CKTILKALGPAATLE; L KALGPAAT; CRQILGQLQPSLQTG; GQLQPSLQT; CRQILGQLQPSL QTG; LGQLQPSLQ; DCKTILKALGPAATL; ILKALGPAA; DCKTILKAL GPAATL; LKALGPAAT; DIAGTTSTLQEQIGW; IAGTTSTLQ; DKELYP LTSLRSLFG; ELYPLTSLR; DKELYPLTSLRSLFG; LYPLTSLRS; DLN TMLNTVGGHQAA; LNTMLNTVG; DLNTMLNTVGGHQAA; MLNTVG GHQ; DRFYKTLRAEQASQE; DRFYKTLRA; DRFYKTLRAEQASQE; F YKTLRAEQ; DRFYKTLRAEQASQE; YKTLRAEQA; DRVHPVHAGPIA PGQ; VHAGPIAPG; DYVDRFYKTLRAEQA; DRFYKTLRA; DYVDRFY KTLRAEQA; FYKTLRAEQ; DYVDRFYKTLRAEQA; VDRFYKTLR; DY VDRFYKTLRAEQA; YVDRFYKTL; EAMSQVTNSATIMMQ; AMSQVT NSA; EAMSQVTNSATIMMQ; VTNSATIMM; EELRSLYNTVATLYC; LR SLYNTVA; EELRSLYNTVATLYC; LYNTVATLY; EESFRSGVETTTPP Q; FRSGVETTT; EGCRQILGQLQPSLQ; CRQILGQLQ; EGCRQILGQ LQPSLQ; ILGQLQPSL; EGCRQILGQLQPSLQ; RQILGQLQP; EIYKR WIILGLNKIV; WIILGLNKI; EIYKRWIILGLNKIV; YKRWIILGL; ELERFA VNPGLLETS; FAVNPGLLE; ELRSLYNTVATLYCV; LYNTVATLY; ELR SLYNTVATLYCV; YNTVATLYC; ELYPLTSLRSLFGND; LTSLRSLFG; ELYPLTSLRSLFGND; LYPLTSLRS; EPIDKELYPLTSLRS; IDKELYPL T; EPRGSDIAGTTSTLQ; EPRGSDIAG; EPRGSDIAGTTSTLQ; GSDIA GTTS; EPRGSDIAGTTSTLQ; RGSDIAGTT; EQASQEVKNWMTETL; EVKNWMTET; EQASQEVKNWMTETL; SQEVKNWMT; EQIGWMTN NPPIPVG; IGWMTNNPP; EQIGWMTNNPPIPVG; MTNNPPIPV; ERFA VNPGLLETSEG; FAVNPGLLE; ERFAVNPGLLETSEG; VNPGLLETS; ERQANFLGKIWPSYK; FLGKIWPSY; ESFRSGVETTTPPQK; FRSGV ETTT; ETLLVQNANPDCKTI; VQNANPDCK; EVIPMFSALSEGATP; IP MFSALSE; EVIPMFSALSEGATP; MFSALSEGA; EVIPMFSALSEGAT P; VIPMFSALS; EVKNWMTETLLVQNA; NWMTETLLV; EVKNWMTET LLVQNA; WMTETLLVQ; FAVNPGLLETSEGCR; VNPGLLETS; FLGKI WPSYKGRPGN; FLGKIWPSY; FLGKIWPSYKGRPGN; GKIWPSYKG; FLGKIWPSYKGRPGN; LGKIWPSYK; FLQSRPEPTAPPEES; FLQS RPEPT; FRNQRKIVKCFNCGK; FRNQRKIVK; FRSGVETTTPPQKQE; VETTTPPQK; FSPEVIPMFSALSEG; VIPMFSALS; FYKTLRAEQASQ EVK; FYKTLRAEQ; FYKTLRAEQASQEVK; YKTLRAEQA; GATPQDL NTMLNTVG; DLNTMLNTV; GATPQDLNTMLNTVG; PQDLNTMLN; G CRQILGQLQPSLQT; LGQLQPSLQ; GEIYKRWIILGLNKI; IYKRWIILG; GEIYKRWIILGLNKI; YKRWIILGL; GGHQAAMQMLKETIN; AAMQML KET; GHKARVLAEAMSQVT; VLAEAMSQV; GKIWPSYKGRPGNFL; GKIWPSYKG; GKKKYKLKHIVWASR; YKLKHIVWA; GLNKIVRMYSP TSIL; IVRMYSPTS; GLNKIVRMYSPTSIL; LNKIVRMYS; GLNKIVRMY SPTSIL; VRMYSPTSI; GNFLQSRPEPTAPPE; FLQSRPEPT; GNFRN QRKIVKCFNC; FRNQRKIVK; GPAATLEEMMTACQG; LEEMMTACQ; GQLQPSLQTGSEELR; GQLQPSLQT; GQMVHQAISPRTLNA; MVHQ AISPR; GQMVHQAISPRTLNA; VHQAISPRT; GRPGNFLQSRPEPTA; FLQSRPEPT; GSDIAGTTSTLQEQI; IAGTTSTLQ; GSEELRSLYNTVA TL; LRSLYNTVA; GTTSTLQEQIGWMTN; LQEQIGWMT; GWMTNNP PIPVGEIY; MTNNPPIPV; HKARVLAEAMSQVTN; LAEAMSQVT; HPV HAGPIAPGQMRE; VHAGPIAPG; IAGTTSTLQEQIGWM; IAGTTSTLQ; IDKELYPLTSLRSLF; LYPLTSLRS; IGWMTNNPPIPVGEI; IGWMTNN PP; IGWMTNNPPIPVGEI; MTNNPPIPV; IGWMTNNPPIPVGEI; WMT NNPPIP; IILGLNKIVRMYSPT; ILGLNKIVR; IILGLNKIVRMYSPT; LGL NKIVRM; IILGLNKIVRMYSPT; LNKIVRMYS; ILGLNKIVRMYSPTS; IL GLNKIVR; ILGLNKIVRMYSPTS; LGLNKIVRM; ILGLNKIVRMYSPTS; LNKIVRMYS; ILGQLQPSLQTGSEE; GQLQPSLQT; ILGQLQPSLQTG SEE; LGQLQPSLQ; ILKALGPAATLEEMM; LKALGPAAT; IMMQRGNF | |

-continued

| Protein accession no/ name | Antigenic peptides | SEQ ID NO |
|---|---|---|
| | RNQRKIV; IMMQRGNFR; IPMFSALSEGATPQD; MFSALSEGA; IPVG EIYKRWIILGL; IYKRWIILG; IQGQMVHQAISPRTL; MVHQAISPR; IQG QMVHQAISPRTL; VHQAISPRT; ISPRTLNAWVKVVEE; LNAWVKVV E; ISPRTLNAWVKVVEE; TLNAWVKVV; IVQNIQGQMVHQAIS; IQGQ MVHQA; IVRMYSPTSILDIRQ; IVRMYSPTS; IVRMYSPTSILDIRQ; VR MYSPTSI; IVRMYSPTSILDIRQ; YSPTSILDI; IWPSYKGRPGNFLQS; YKGRPGNFL; IYKRWIILGLNKIVR; WIILGLNKI; IYKRWIILGLNKIVR; YKRWIILGL; KAFSPEVIPMFSALS; EVIPMFSAL; KAFSPEVIPMFSAL S; FSPEVIPMF; KAFSPEVIPMFSALS; KAFSPEVIP; KALGPAATLEE MMTA; LGPAATLEE; KARVLAEAMSQVTNS; LAEAMSQVT; KELYPL TSLRSLFGN; ELYPLTSLR; KELYPLTSLRSLFGN; LYPLTSLRS; KGR PGNFLQSRPEPT; GRPGNFLQS; KGRPGNFLQSRPEPT; NFLQSRP EP; KIVRMYSPTSILDIR; IVRMYSPTS; KIVRMYSPTSILDIR; VRMYS PTSI; KIVRMYSPTSILDIR; YSPTSILDI; KIWPSYKGRPGNFLQ; YKG RPGNFL; KKKYKLKHIVWASRE; LKHIVWASR; KKKYKLKHIVWASR E; YKLKHIVWA; KKYKLKHIVWASREL; LKHIVWASR; KKYKLKHIVW ASREL; YKLKHIVWA; KLKHIVWASRELERF; LKHIVWASR; KNWMTE TLLVQNANP; WMTETLLVQ; KRWIILGLNKIVRMY; ILGLNKIVR; KRW IILGLNKIVRMY; LGLNKIVRM; KRWIILGLNKIVRMY; WIILGLNKI; KTIL KALGPAATLEE; ILKALGPAA; KTILKALGPAATLEE; LKALGPAAT; KY KLKHIVWASRELE; LKHIVWASR; LAEAMSQVTNSATIM; AMSQVTN SA; LAEAMSQVTNSATIM; LAEAMSQVT; LEEMMTACQGVGGPG; M TACQGVGG; LERFAVNPGLLETSE; FAVNPGLLE; LERFAVNPGLLE TSE; VNPGLLETS; LGKIWPSYKGRPGNF; LGKIWPSYK; LGLNKIVR MYSPTSI; IVRMYSPTS; LGLNKIVRMYSPTSI; LGLNKIVRM; LGLNKI VRMYSPTSI; LNKIVRMYS; LGPAATLEEMMTACQ; AATLEEMMT; LG QLQPSLQTGSEEL; LGQLQPSLQ; LKALGPAATLEEMMT; LKALGPA AT; LKHIVWASRELERFA; LKHIVWASR; LLVQNANPDCKTILK; VQN ANPDCK; LNKIVRMYSPTSILD; IVRMYSPTS; LNKIVRMYSPTSILD; L NKIVRMYS; LNKIVRMYSPTSILD; VRMYSPTSI; LNTMLNTVGGHQA AM; LNTMLNTVG; LNTMLNTVGGHQAAM; MLNTVGGHQ; LNTVGG HQAAMQMLK; VGGHQAAMQ; LQEQIGWMTNNPPIP; IGWMTNNPP; LRSLYNTVATLYCVH; LYNTVATLY; LRSLYNTVATLYCVH; YNTVAT LYC; LTSLRSLFGNDPSSQ; LTSLRSLFG; LYNTVATLYCVHQRI; LYN TVATLY; LYNTVATLYCVHQRI; YNTVATLYC; LYPLTSLRSLFGNDP; LTSLRSLFG; LYPLTSLRSLFGNDP; LYPLTSLRS; MFSALSEGATPQ DLN; MFSALSEGA; MGARASVLSGGELDR; MGARASVLS; MLNTVG GHQAAMQML; MLNTVGGHQ; MLNTVGGHQAAMQML; VGGHQAA MQ; MMQRGNFRNQRKIVK; NFRNQRKIV; MMQRGNFRNQRKIVK; Q RGNFRNQR; MMQRGNFRNQRKIVK; RGNFRNQRK; MQRGNFRNQ RKIVKC; FRNQRKIVK; MSQVTNSATIMMQRG; VTNSATIMM; MTETL LVQNANPDCK; LLVQNANPD; MTETLLVQNANPDCK; MTETLLVQN; MTNNPPIPVGEIYKR; MTNNPPIPV; MVHQAISPRTLNAWV; MVHQAI SPR; MVHQAISPRTLNAWV; VHQAISPRT; NFLGKIWPSYKGRPG; F LGKIWPSY; NFLGKIWPSYKGRPG; GKIWPSYKG; NFLGKIWPSYKG RPG; LGKIWPSYK; NFLQSRPEPTAPPEE; FLQSRPEPT; NFRNQRKI VKCFNCG; FRNQRKIVK; NIQGQMVHQAISPRT; IQGQMVHQA; NIQ GQMVHQAISPRT; MVHQAISPR; NKIVRMYSPTSILDI; IVRMYSPTS; NKIVRMYSPTSILDI; VRMYSPTSI; NPDCKTILKALGPAA; CKTILKAL G; NPDCKTILKALGPAA; KTILKALGP; NSATIMMQRGNFRNQ; IMMQ RGNFR; NTMLNTVGGHQAAM; LNTVGGHQA; NTMLNTVGGHQA AMQ; MLNTVGGHQ; NTVGGHQAAMQMLKE; VGGHQAAMQ; NYPIV QNIQGQMVHQ; VQNIQGQMV; PDCKTILKALGPAAT; CKTILKALG; P DCKTILKALGPAAT; ILKALGPAA; PEESFRSGVETTTPP; FRSGVET TT; PEVIPMFSALSEGAT; VIPMFSALS; PGHKARVLAEAMSQV; ARV LAEAMS; PGNFLQSRPEPTAPP; FLQSRPEPT; PIDKELYPLTSLRSL; LYPLTSLRS; PIVQNIQGQMVHQAI; VQNIQGQMV; PLTSLRSLFGN DPSS; LTSLRSLFG; PMFSALSEGATPQDL; MFSALSEGA; PPEESF RSGVETTTP; FRSGVETTT; PQDLNTMLNTVGGHQ; DLNTMLNTV; P QDLNTMLNTVGGHQ; LNTMLNTVG; PRGSDIAGTTSTLQE; IAGTTS TLQ; PRTLNAWVKVVEEKA; LNAWVKVVE; PRTLNAWVKVVEEKA; T LNAWVKVV; PSYKGRPGNFLQSRP; YKGRPGNFL; PVGEIYKRWIIL GLN; YKRWIILGL; PVHAGPIAPGQMREP; VHAGPIAPG; PAATLEEM MTACQGV; LEEMMTACQ; QAISPRTLNAWVKVV; ISPRTLNAW; QA NFLGKIWPSYKGR; FLGKIWPSY; QANFLGKIWPSYKGR; GKIWPSY KG; QANFLGKIWPSYKGR; LGKIWPSYK; QASQEVKNWMTETLL; VK NWMTETL; QDLNTMLNTVGGHQA; LNTMLNTVG; QDLNTMLNTVG GHQA; MLNTVGGHQ; QEQIGWMTNNPPIPV; IGWMTNNPP; QEVKN WMTETLLVQN; VKNWMTETL; QGQMVHQAISPRTLN; MVHQAISPR; QGQMVHQAISPRTLN; VHQAISPRT; QIGWMTNNPPIPVGE; IGWM TNNPP; QIGWMTNNPPIPVGE; MTNNPPIPV; QIGWMTNNPPIPVGE; WMTNNPPIP; QILGQLQPSLQTGSE; GQLQPSLQT; QILGQLQPSL QTGSE; LGQLQPSLQ; QMVHQAISPRTLNAW; MVHQAISPR; QMVH QAISPRTLNAW; VHQAISPRT; QNIQGQMVHQAISPR; IQGQMVHQA; QNYPIVQNIQGQMVH; VQNIQGQMV; QRGNFRNQRKIVKCF; FRN | |

| Protein accession no/ name | Antigenic peptides | SEQ ID NO |
|---|---|---|
| | QRKIVK; QTGSEELRSLYNTVA; SEELRSLYN; QVTNSATIMMQRGN F; VTNSATIMM; RDYVDRFYKTLRAEQ; DRFYKTLRA; RDYVDRFYK TLRAEQ; DYVDRFYKT; RDYVDRFYKTLRAEQ; VDRFYKTLR; RELE RFAVNPGLLET; FAVNPGLLE; RELERFAVNPGLLET; LERFAVNPG; RFAVNPGLLETSEGC; FAVNPGLLE; RFAVNPGLLETSEGC; VNPGL LETS; RFYKTLRAEQASQEV; FYKTLRAEQ; RFYKTLRAEQASQEV; YKTLRAEQA; RGNFRNQRKIVKCFN; FRNQRKIVK; RGSDIAGTTST LQEQ; IAGTTSTLQ; RMYSPTSILDIRQGP; YSPTSILDI; RPGNFLQSR PEPTAP; FLQSRPEPT; RQANFLGKIWPSYKG; FLGKIWPSY; RQAN FLGKIWPSYKG; LGKIWPSYK; RQILGQLQPSLQTGS; GQLQPSLQT; RQILGQLQPSLQTGS; LGQLQPSLQ; RSGVETTTPPQKQEP; VETTT PPQK; RSLYNTVATLYCVHQ; LYNTVATLY; RSLYNTVATLYCVHQ; Y NTVATLYC; RTLNAWVKVVEEKAF; LNAWVKVVE; RTLNAWVKVVE EKAF; TLNAWVKVV; RVHPVHAGPIAPGQM; VHAGPIAPG; RVLAEA MSQVTNSAT; AMSQVTNSA; RVLAEAMSQVTNSAT; LAEAMSQVT; RWIILGLNKIVRMYS; ILGLNKIVR; RWIILGLNKIVRMYS; LGLNKIVR M; RWIILGLNKIVRMYS; WIILGLNKI; SATIMMQRGNFRNQR; IMMQR GNFR; SDIAGTTSTLQEQIG; IAGTTSTLQ; SEELRSLYNTVATLY; LR SLYNTVA; SFRSGVETTTPPQKQ; FRSGVETTT; SFRSGVETTTPPQ KQ; VETTTPPQK; SGVETTTPPQKQEPI; VETTTPPQK; SLYNTVATL YCVHQR; LYNTVATLY; SLYNTVATLYCVHQR; YNTVATLYC; SPEVI PMFSALSEGA; VIPMFSALS; SPRTLNAWVKVVEEK; LNAWVKVVE; SPRTLNAWVKVVEEK; TLNAWVKVV; SQEVKNWMTETLLVQ; VKN WMTETL; SQNYPIVQNIQGQMV; IVQNIQGQM; SQNYPIVQNIQGQM V; SQNYPIVQN; SQVTNSATIMMQRGN; VTNSATIMM; SRELERFAV NPGLLE; LERFAVNPG; STLQEQIGWMTNNPP; LQEQIGWMT; STLQ EQIGWMTNNP; SYKGRPGNFLQSRPE; YKGRPGN FL; TERQANFLGKIWPSY; ANFLGKIWP; TETLLVQNANPDCKT; VQN ANPDCK; TGSEELRSLYNTVAT; LRSLYNTVA; TILKALGPAATLEEM; LKALGPAAT; TIMMQRGNFRNQRKI; IMMQRGNFR; TLEEMMTACQ GVGGP; MTACQGVGG; TLLVQNANPDCKTIL; VQNANPDCK; TLNA WVKVVEEKAFS; LNAWVKVVE; TLQEQIGWMTNNPPI; IGWMTNNP P; TMLNTVGGHQAAMQM; MLNTVGGHQ; TMLNTVGGHQAAMQM; VGGHQAAMQ; TNSATIMMQRGNFRN; IMMQRGNFR; TPQDLNTML NTVGGH; LNTMLNTVG; TSTLQEQIGWMTNNP; LQEQIGWMT; TTST LQEQIGWMTNN; LQEQIGWMT; TVGGHQAAMQMLKET; VGGHQAA MQ; VDRFYKTLRAEQASQ; DRFYKTLRA; VDRFYKTLRAEQASQ; FY KTLRAEQ; VDRFYKTLRAEQASQ; YKTLRAEQA; VGEIYKRWIILGLN K; YKRWIILGL; VGGHQAAMQMLKETI; VGGHQAAMQ; VHAGPIAPG QMREPR; VHAGPIAPG; VHPVHAGPIAPGQMR; VHAGPIAPG; VHQA ISPRTLNAWVK; VHQAISPRT; VIPMFSALSEGATPQ; MFSALSEGA; VIPMFSALSEGATPQ; VIPMFSALS; VKNWMTETLLVQNAN; NWMTE TLLV; VKNWMTETLLVQNAN; WMTETLLVQ; VLAEAMSQVTNSATI; AMSQVTNSA; VLAEAMSQVTNSATI; LAEAMSQVT; VQNIQGQMVH QAISP; IQGQMVHQA; VRMYSPTSILDIRQG; MYSPTSILD; VRMYSP TSILDIRQG; VRMYSPTSI; VRMYSPTSILDIRQG; YSPTSILDI; VTNSA TIMMQRGNFR; SATIMMQRG; VTNSATIMMQRGNFR; VTNSATIMM; WDRVHPVHAGPIAPG; VHPVHAGPI; WIILGLNKIVRMYS; ILGLNKI VR; WIILGLNKIVRMYSP; LGLNKIVRM; WIILGLNKIVRMYSP; LNKIV RMYS; WIILGLNKIVRMYSP; WIILGLNKI; WMTNNPPIPVGEIYK; MTN NPPIPV; WPSYKGRPGNFLQSR; YKGRPGNFL; YKGRPGNFLQSRP EP; YKGRPGNFL; YKLKHIVWASRELER; LKHIVWASR; YKRWIILGL NKIVRM; ILGLNKIVR; YKRWIILGLNKIVRM; WIILGLNKI; YKTLRAEQ ASQEVKN; YKTLRAEQA; YNTVATLYCVHQRIE; YNTVATLYC; YPIV QNIQGQMVHQA; VQNIQGQMV; YPLTSLRSLFGNDPS; LTSLRSLF G; YVDRFYKTLRAEQAS; DRFYKTLRA; YVDRFYKTLRAEQAS; FYK TLRAEQ; YVDRFYKTLRAEQAS; YKTLRAEQA; AATLEEMMTACQG VG; LEEMMTACQ | |
| NP_057851 Vif | 8-mers: MENRWQVM; RWQVMIVW; WQVMIVWQ; QVMIVWQV; MIVWQVDR; IVWQVDRM; WQVDRMRI; RMRIRTWK; RIRTWKSL; RTWKSLVK; K SLVKHHM; SLVKHHMY; LVKHHMYV; HMYVSGKA; MYVSGKAR; VS GKARGW; KARGWFYR; GWFYRHHY; HYESPHPR; YESPHPRI; SPH PRISS; HPRISSEV; RISSEVHI; HIPLGDAR; IPLGDARL; PLGDARLV; ARLVITTY; RLVITTYW; VITTYWGL; TTYWGLHT; HLGQGVSI; QGVSI EWR; GVSIEWRK; VSIEWRKK; SIEWRKKR; TQVDPELA; DPELADQL; LADQLIHL; DQLIHLYY; QLIHLYYF; HLYYFDCF; DCFSDSAI; CFSDS AIR; FSDSAIRK; KALLGHIV; ALLGHIVS; LGHIVSPR; IVSPRCEY; EYQ AGHNK; YQAGHNKV; KVGSLQYL; SLQYLALA; LQYLALAA; QYLALA AL; YLALAALI; ALAALITP; LAALITPK; AALITPKK; ALITPKKI; PLPSVT KL; LPSVTKLT; VTKLTEDR; LTEDRWNK; PQKTKGHR 9-mers: WQVMIVWQV; VMIVWQVDR; MIVWQVDRM; IVWQVDRMR; VWQV DRMRI; WQVDRMRIR; RMRIRTWKS; RIRTWKSLV; IRTWKSLVK; RT | 4963-5538 |

| Protein accession no/name | Antigenic peptides | SEQ ID NO |
|---|---|---|
| | WKSLVKH; KSLVKHHMY; SLVKHHMYV; KHHMYVSGK; HMYVSGKAR; SGKARGWFY; KARGWFYRH; RGWFYRHHY; HHYESPHPR; SPHPRISSE; HPRISSEVH; ISSEVHIPL; SEVHIPLGD; HIPLGDARL; IPLGDARLV; PLGDARLVI; DARLVITTY; LVITTYWGL; WHLGQGVSI; LGQGVSIEW; GQGVSIEWR; GVSIEWRKK; VSIEWRKKR; ELADQLIHL; LADQLIHLY; DQLIHLYYF; IHLYYFDCF; HLYYFDCFS; DCFSDSAIR; ALLGHIVSP; LLGHIVSPR; HIVSPRCEY; KVGSLQYLA; SLQYLALAA; LQYLALAAL; QYLALAALI; YLALAALIT; ALAALITPK; LAALITPKK; ALITPKKI K; TPKKIKPPL; KIKPPLPSV; SVTKLTEDR; VTKLTEDRW; KLTEDRWNK; RWNKPQKTK; KPQKTKGHR; KTKGHRGSH<br>10-mers:<br>MENRWQVMIV; RWQVMIVWQV; QVMIVWQVDR; VMIVWQVDRM; MIVWQVDRMR; IVWQVDRMRI; VWQVDRMRIR; WQVDRMRIRT; RMRIRTWKSL; RIRTWKSLVK; KSLVKHHMYV; SLVKHHMYVS; MYVSGKARGW; YVSGKARGWF; VSGKARGWFY; SGKARGWFYR; RHHYESPHPR; HHYESPHPRI; YESPHPRISS; SPHPRISSEV; HPRISSEVHI; RISSEVHIPL; EVHIPLGDAR; HIPLGDARLV; IPLGDARLVI; PLGDARLVIT; RLVITTYWGL; TTYWGLHTGE; TYWGLHTGER; HLGQGVSIEW; GQGVSIEWRK; GVSIEWRKKR; VSIEWRKKRY; RYSTQVDPEL; QVDPELADQL; DPELADQLIH; PELADQLIHL; ELADQLIHLY; LADQLIHLYY; YYFDCFSDSA; YFDCFSDSAI; FDCFSDSAIR; AIRKALLGHI; ALLGHIVSPR; LLGHIVSPRC; IVSPRCEYQA; CEYQAGHNKV; KVGSLQYLAL; SLQYLALAAL; LQYLALAALI; YLALAALITP; LALAALITPK; ALAALITPKK; AALITPKKIK; KKIKPPLPSV; KPPLPSVTKL; KTKGHRGSHT<br>11-mers:<br>MENRWQVMIVW; NRWQVMIVWQV; WQVMIVWQVDR; QVMIVWQVDRM; VMIVWQVDRMR; MIVWQVDRMRI; IVWQVDRMRIR; WQVDRMRIRTW; QVDRMRIRTWK; RMRIRTWKSLV; MRIRTWKSLVK; RIRTWKSLVKH; RTWKSLVKHHM; TWKSLVKHHMY; WKSLVKHHMYV; LVKHHMYVSGK; KHHMYVSGKAR; HMYVSGKARGW; MYVSGKARGWF; YVSGKARGWFY; VSGKARGWFYR; KARGWFYRHHY; ESPHPRISSEV; EVHIPLGDARL; IPLGDARLVIT; PLGDARLVITT; ARLVITTYWGL; RLVITTYWGLH; LVITTYWGLHT; TTYWGLHTGER; YWGLHTGERDW; GLHTGERDWHL; WHLGQGVSIEW; HLGQGVSIEWR; KRYSTQVDPEL; TQVDPELADQL; QVDPELADQLI; DPELADQLIHL; PELADQLIHLY; ELADQLIHLYY; LADQLIHLYYF; QLIHLYYFDCF; YYFDCFSDSAI; AIRKALLGHIV; KALLGHIVSPR; ALLGHIVSPRC; HIVSPRCEYQA; YQAGHNKVGSL; KVGSLQYLALA; GSLQYLALAAL; SLQYLALAALI; LQYLALAALIT; YLALAALITPK; LALAALITPKK; ALAALITPKKI; LAALITPKKIK; LITPKKIKPPL; KIKPPLPSVTK; VTKLTEDRWNK; KLTEDRWNKPQ; LTEDRWNKPQK; KTKGHRGSHTM<br>15-mer + 9-mer core:<br>ADQLIHLYYFDCFSD; IHLYYFDCF; AGHNKVGSLQYLALA; VGSLQYLAL; AIRKALLGHIVSPRC; LLGHIVSPR; AIRKALLGHIVSPRC; RKALLGHIV; ALLGHIVSPRCEYQA; LLGHIVSPR; ARLVITTYWGLHTGE; LVITTYWGL; ARLVITTYWGLHTGE; VITTYWGLH; CEYQAGHNKVGSL QY; YQAGHNKVG; CFSDSAIRKALLGHI; AIRKALLGH; DARLVITTYWGLH

| Protein accession no/ name | Antigenic peptides | SEQ ID NO |
|---|---|---|
| | LALAAL; KVGSLQYLALAALIT; QYLALAALI; LADQLIHLYYFDCFS; IHLYYFDCF; LALAALITPKKIKPP; LAALITPKK; LGDARLVITTYWGLH; LGDARLVIT; LGDARLVITTYWGLH; LVITTYWGL; LGQGVSIEWRKKRYS; VSIEWRKKR; LITPKKIKPPLPSVT; KKIKPPLPS; LITPKKIKPPLPSVT; PKKIKPPLP; LLGHIVSPRCEYQAG; LLGHIVSPR; LQYLALAALITPKKI; LALAALITP; LQYLALAALITPKKI; LAALITPKK; LQYLALAALITPKKI; YLALAALIT; LVITTYWGLHTGERD; VITTYWGLH; LVITTYWGLHTGERD; YWGLHTGER; LVKHHMYVSGKARGW; VKHHMYVSG; MENRWQVMIVWQVDR; WQVMIVWQV; MIVWQVDRMRIRTWK; IVWQVDRMR; MIVWQVDRMRIRTWK; MIVWQVDRM; MIVWQVDRMRIRTWK; WQVDRMRIR; MRIRTWKSLVKHHMY; IRTWKSLVK; MRIRTWKSLVKHHMY; WKSLVKHHM; MYVSGKARGWFYRHH; GKARGWFYR; MYVSGKARGWFYRHH; YVSGKARGW; NKVGSLQYLALAALI; LQYLALAAL; NRWQVMIVWQVDRMR; MIVWQVDRM; NRWQVMIVWQVDRMR; WQVMIVWQV; PKKIKPPLPSVTKLT; IKPPLPSVT; PLGDARLVITTYWGL; ARLVITTYW; PLGDARLVITTYWGL; LGDARLVIT; PRCEYQAGHNKVGSL; YQAGHNKVG; QAGHNKVGSLQYLAL; NKVGSLQYL; QGVSIEWRKKRYSTQ; IEWRKKRYS; QGVSIEWRKKRYSTQ; VSIEWRKKR; QLIHLYYFDCFSDSA; IHLYYFDCF; QVDRMRIRTWKSLVK; DRMRIRTWK; QVDRMRIRTWKSLVK; MRIRTWKSL; QVDRMRIRTWKSLVK; RMRIRTWKS; QVMIVWQVDRMRIRT; IVWQVDRMR; QVMIVWQVDRMRIRT; MIVWQVDRM; QYLALAALITPKKIK; LALAALITP; QYLALAALITPKKIK; LAALITPKK; QYLALAALITPKKIK; YLALAALIT; RCEYQAGHNKVGSLQ; YQAGHNKVG; RDWHLGQGVSIEWRK; WHLGQGVSI; RHHYESPHPRISSEV; YESPHPRIS; RIRTWKSLVKHHMYV; IRTWKSLVK; RIRTWKSLVKHHMYV; WKSLVKHHM; RKALLGHIVSPRCEY; LGHIVSPRC; RKALLGHIVSPRCEY; LLGHIVSPR; RKKRYSTQVDPELAD; KKRYSTQVD; RLVITTYWGLHTGER; ITTYWGLHT; RLVITTYWGLHTGER; VITTYWGLH; RMRIRTWKSLVKHHM; IRTWKSLVK; RMRIRTWKSLVKHHM; RTWKSLVKH; RTWKSLVKHHMYVSG; WKSLVKHHM; RWQVMIVWQVDRMRI; MIVWQVDRM; RWQVMIVWQVDRMRI; WQVMIVWQV; SAIRKALLGHIVSPR; AIRKALLGH; SAIRKALLGHIVSPR; RKALLGHIV; SDSAIRKALLGHIVS; AIRKALLGH; SDSAIRKALLGHIVS; IRKALLGHI; SEVHIPLGDARLVIT; IPLGDARLV; SIEWRKKRYSTQVDP; WRKKRYSTQ; SLQYLALAALITPKK; ALAALITPK; SLQYLALAALITPKK; LALAALITP; SLQYLALAALITPKK; YLALAALIT; SLVKHHMYVSGKARG; VKHHMYVSG; SPRCEYQAGHNKVGS; YQAGHNKVG; SSEVHIPLGDARLVI; IPLGDARLV; TGERDWHLGQGVSIE; WHLGQGVSI; TPKKIKPPLPSVTKL; IKPPLPSVT; TWKSLVKHHMYVSGK; VKHHMYVSG; TWKSLVKHHMYVSGK; WKSLVKHHM; VDRMRIRTWKSLVKH; IRTWKSLVK; VGSLQYLALAALITP; LQYLALAAL; VGSLQYLALAALITP; YLALAALIT; VHIPLGDARLVITTY; IPLGDARLV; VITTYWGLHTGERDW; VITTYWGLH; VITTYWGLHTGERDW; YWGLHTGER; VKHHMYVSGKARGWF; YVSGKARGW; VMIVWQVDRMRIRTW; IVWQVDRMR; VMIVWQVDRMRIRTW; MIVWQVDRM; VMIVWQVDRMRIRTW; WQVDRMRIR; VSGKARGWFYRHHYE; ARGWFYRHH; VSIEWRKKRYSTQVD; IEWRKKRYS; VSIEWRKKRYSTQVD; VSIEWRKKR; VSIEWRKKRYSTQVD; WRKKRYSTQ; VSPRCEYQAGHNKVG; EYQAGHNKV; VWQVDRMRIRTWKSL; RMRIRTWKS; VWQVDRMRIRTWKSL; VDRMRIRTW; WFYRHHYESPHPRIS; YRHHYESPH; WHLGQGVSIEWRKKR; GQGVSIEWR; WHLGQGVSIEWRKKR; LGQGVSIEW; WKSLVKHHMYVSGKA; VKHHMYVSG; WKSLVKHHMYVSGKA; WKSLVKHHM; WQVDRMRIRTWKSLV; MRIRTWKSL; WQVDRMRIRTWKSLV; RMRIRTWKS; WQVMIVWQVDRMRIR; MIVWQVDRM; WQVMIVWQVDRMRIR; VMIVWQVDR; WQVMIVWQVDRMRIR; WQVMIVWQV; YLALAALITPKKIKP; LAALITPKK; YLALAALITPKKIKP; YLALAALIT; YQAGHNKVGSLQYLA; YQAGHNKVG; YRHHYESPHPRISSE; YESPHPRIS; YVSGKARGWFYRHHY; ARGWFYRHH; YVSGKARGWFYRHHY; YVSGKARGW | |
| NP_057852 Vpr | 8-mers: EPHNEWTL; HNEWTLEL; NEWTLELL; TLELLEEL; EELKNEAV; ELKNEAVR; EAVRHFPR; AVRHFPRI; GQHIYETY; ETYGDTWA; YGDTWAGV; DTWAGVEA; TWAGVEAI; VEAIIRIL; RILQQLLF; ILQQLLFI; QQLLFIHF; QLLFIHFR; LLFIHFRI; RIGCRHSR; HSRIGVTR; RIGVTRQR; VTRQRRAR; RARNGASR 9-mers: REPHNEWTL; PHNEWTLEL; WTLELLEEL; TLELLEELK; LLEELKNEA; NEAVRHFPR; EAVRHFPRI; FPRIWLHGL; WLHGLGQHI; GLGQHIYET; IYETYGDTW; YETYGDTWA; ETYGDTWAG; TYGDTWAGV; DTWAGVEAI; TWAGVEAII; AIIRILQQL; IRILQQLLF; RILQQLLFI; LQQLLFIHF; QQLLFIHFR; QLLFIHFRI; FIHFRIGCR; FRIGCRHSR; RIGCRHSRI; RHSRIGVTR; SRIGVTRQR; RIGVTRQRR; GVTRQRRAR; RQRRARNGA; RRARNGASR | 5539-5757 |

| Protein accession no/ name | Antigenic peptides | SEQ ID NO |
|---|---|---|
| | 10-mers:<br>QAPEDQGPQR; EPHNEWTLEL; WTLELLEELK; ELLEELKNEA; LLEE<br>LKNEAV; ELKNEAVRHF; KNEAVRHFPR; EAVRHFPRIW; AVRHFPRI<br>WL; HFPRIWLHGL; FPRIWLHGLG; IWLHGLGQHI; WLHGLGQHIY; G<br>LGQHIYETY; HIYETYGDTW; ETYGDTWAGV; DTWAGVEAII; TWAG<br>VEAIIR; EAIIRILQQL; AIIRILQQLL; ILQQLLFIHF; LQQLLFIHFR; QQLL<br>FIHFRI; LLFIHFRIGC; LFIHFRIGCR; HFRIGCRHSR; FRIGCRHSRI; C<br>RHSRIGVTR; HSRIGVTRQR; SRIGVTRQRR; QRRARNGASR<br>11-mers:<br>EQAPEDQGPQR; REPHNEWTLEL; EPHNEWTLELL; NEWTLELLEE<br>L; ELLEELKNEAV; EELKNEAVRHF; EAVRHFPRIWL; RHFPRIWLHG<br>L; RIWLHGLGQHI; IWLHGLGQHIY; WLHGLGQHIYE; HIYETYGDTW<br>A; YETYGDTWAGV; ETYGDTWAGVE; DTWAGVEAIIR; TWAGVEAII<br>RI; VEAIIRILQQL; EAIIRILQQLL; AIIRILQQLLF; IIRILQQLLFI; RILQQL<br>LFIHF; ILQQLLFIHFR; LQQLLFIHFRI; QLLFIHFRIGC; LLFIHFRIGCR;<br>IHFRIGCRHSR; RIGCRHSRIGV; GCRHSRIGVTR; HSRIGVTRQRR;<br>RIGVTRQRRAR; RQRRARNGASR<br>15-mer + 9-mer core:<br>AGVEAIIRILQQLLF; VEAIIRILQ; AIIRILQQLLFIHFR; ILQQLLFIH; AIIR<br>ILQQLLFIHFR; IRILQQLLF; AIIRILQQLLFIHFR; LQQLLFIHF; DTWAG<br>VEAIIRILQQ; WAGVEAIIR; EAIIRILQQLLFIHF; IIRILQQLL; EAIIRILQ<br>QLLFIHF; ILQQLLFIH; EAIIRILQQLLFIHF; IRILQQLLF; EAVRHFPRI<br>WLHGLG; VRHFPRIWL; EELKNEAVRHFPRIW; LKNEAVRHF; ELKN<br>EAVRHFPRIWL; LKNEAVRHF; ELKNEAVRHFPRIWL; NEAVRHFPR;<br>ELLEELKNEAVRHFP; LKNEAVRHF; ETYGDTWAGVEAIIR; DTWAG<br>VEAI; FIHFRIGCRHSRIGV; FIHFRIGCR; FPRIWLHGLGQHIYE; IWLH<br>GLGQH; FPRIWLHGLGQHI; GDTWAGVEAIIRILQ; IRILQQLL;<br>WAGVEAIIR; GVEAIIRILQQLLFI; IRILQQLLF; HFPRIWLHGLGQHIY; I<br>WLHGLGQH; HFPRIWLHGLGQHIY; WLHGLGQHI; IIRILQQLLFIHFR<br>I; ILQQLLFIH; IIRILQQLLFIHFRI; IRILQQLLF; ILQQLLFIHFRI; LQQ<br>LLFIHF; ILQQLLFIHFRIGCR; ILQQLLFIH; ILQQLLFIHFRIGCR; LLFIH<br>FRIG; IRILQQLLFIHFRIG; ILQQLLFIH; IRILQQLLFIHFRIG; IRILQQLL<br>F; KNEAVRHFPRIWLHG; VRHFPRIWL; LEELKNEAVRHFPRI; LKNE<br>AVRHF; LELLEELKNEAVRHF; ELKNEAVRH; LELLEELKNEAVRHF;<br>LEELKNEAV; LFIHFRIGCRHSRIG; FIHFRIGCR; LKNEAVRHFPRIW<br>LH; LKNEAVRHF; LKNEAVRHFPRIWLH; VRHFPRIWL; LLEELKNEA<br>VRHFPR; LKNEAVRHF; LLFIHFRIGCRHSRI; FIHFRIGCR; LQQLLFI<br>HFRIGCRH; FIHFRIGCR; NEAVRHFPRIWLHGL; VRHFPRIWL; PRIW<br>LHGLGQHIYET; WLHGLGQH; QLLFIHFRIGCRHSR; FIHFRIGCR; Q<br>QLLFIHFRIGCRHS; FIHFRIGCR; RHFPRIWLHGLGQHI; FPRIWLHG<br>L; RHFPRIWLHGLGQHI; IWLHGLGQH; RILQQLLFIHFRIGC; ILQQLL<br>FIH; RIWLHGLGQHIYETY; WLHGLGQHI; TYGDTWAGVEAIIRI; WAG<br>VEAIIR; VEAIIRILQQLLFIH; IRILQQLLF; VRHFPRIWLHGLGQH; FPRI<br>WLHGL; WAGVEAIIRILQQLL; WAGVEAIIR; YGDTWAGVEAIIRIL; WA<br>GVEAIIR | |
| NP_057853 Tat | 8-mers:<br>MQPIPIVA; QPIPIVAI; PIPIVAIV; IPIVAIVA; PIVAIVAL; IVAIVALV; VAIV<br>ALVV; AIVALVVA; IVALVVAI; ALVVAIII; LVVAIIIA; VVAIIIAI; VAIIIAIV; AI<br>IIAIVV; IIIAIVVW; IAIVVWSI; AIVVWSIV; IVVWSIVI; VVWSIVII; WSIVII<br>EY; SIVIIEYR; IVIIEYRK; VIIEYRKI; IEYRKILR; RKILRQRK; SEGEISAL;<br>EISALVEM; SALVEMGV; LVEMGVEM; APWDVDDL<br>9-mers:<br>MQPIPIVAI; QPIPIVAIV; IPIVAIVAL; PIVAIVALV; IVAIVALVV; AIVALV<br>VAI; IVALVVAII; VALVVAIII; ALVVAIIIA; LVVAIIIAI; VVAIIIAIV; VAIIIAIV<br>V; AIIIAIVVW; IIAIVVWSI; IAIVVWSIV; AIVVWSIVI; IVVWSIVII; VWSIVI<br>IEY; WSIVIIEYR; SIVIIEYRK; VIIEYRKIL; IIEYRKILR; EYRKILRQR; YR<br>KILRQRK; ILRQRKIDR; KIDRLIDRL; RLIDRLIER; LIDRLIERA; ESEGE<br>ISAL; SEGEISALV; GEISALVEM; ISALVEMGV; ALVEMGVEM; VEMG<br>HHAPW<br>10-mers:<br>MQPIPIVAIV; QPIPIVAIVA; IPIVAIVALV; PIVAIVALVV; VAIVALVVAI; A<br>IVALVVAII; IVALVVAIII; ALVVAIIIAI; LVVAIIIAIV; VVAIIIAIVV; VAIIIAIV<br>VW; IIIAIVVWSI; IIAIVVWSIV; IAIVVWSIVI; AIVVWSIVII; VVWSIVIIEY;<br>VWSIVIIEYR; WSIVIIEYRK; VIIEYRKILR; IEYRKILRQR; EYRKILRQR<br>K; KILRQRKIDR; ILRQRKIDRL; KIDRLIDRLI; RLIDRLIERA; NESEGEI<br>SAL; ESEGEISALV; EISALVEMGV; SALVEMGVEM; EMGHHAPWDV;<br>HHAPWDVDDL<br>11-mers:<br>MQPIPIVAIVA; QPIPIVAIVAL; PIPIVAIVALV; IPIVAIVALVV; IVAIVALV<br>VAI; VAIVALVVAII; AIVALVVAIII; IVALVVAIIIA; ALVVAIIIAIV; LVVAIIIAI<br>VV; VVAIIIAIVVW; AIIIAIVVWSI; IIIAIVVWSIV; IIAIVVWSIVI; IAIVVWSI<br>VII; IVVWSIVIIEY; VVWSIVIIEYR; VWSIVIIEYRK; WSIVIIEYRKI; SIVII<br>EYRKIL; IVIIEYRKILR; IIEYRKILRQR; EYRKILRQRKI; KILRQRKIDRL;<br>ILRQRKIDRLI; RQRKIDRLIDR; NESEGEISALV; SEGEISALVEM; GEI | 5758-6044 |

| Protein accession no/ name | Antigenic peptides | SEQ ID NO |
|---|---|---|
| | SALVEMGV; ISALVEMGVEM; MGVEMGHHAPW; VEMGHHAPWDV<br>15-mer + 9-mer core:<br>AIIIAIVVWSIVIIE; IIAIVVWSI; AIIIAIVVWSIVIIE; IVVWSIVII; AIVALVV<br>AIIIAIVV; IVALVVAII; AIVALVVAIIIAIVV; LVVAIIIAI; AIVVWSIVIIEYRKI;<br>IVVWSIVII; AIVVWSIVIIEYRKI; VVWSIVIIE; AIVVWSIIEYRKI; WSI<br>VIIEYR; ALVEMGVEMGHHAPW; LVEMGVEMG; ALVVAIIIAIVVWSI; I<br>IIAIVVWS; ALVVAIIIAIVVWSI; VAIIIAIVV; ALVVAIIIAIVVWSI; VVAIIIAI<br>V; EGEISALVEMGVEMG; ISALVEMGV; EISALVEMGVEMGHH; LVE<br>MGVEMG; EMGVEMGHHAPWDVD; MGHHAPWDV; EYRKILRQRKI<br>DRLI; ILRQRKIDR; EYRKILRQRKIDRLI; LRQRKIDRL; EYRKILRQRKI<br>DRLI; YRKILRQRK; GEISALVEMGVEMGH; LVEMGVEMG; GVEMGH<br>HAPWDVDDL; MGHHAPWDV; IAIVVWSIVIIEYRK; IVVWSIVII; IEYRK<br>ILRQRKIDRL; ILRQRKIDR; IEYRKILRQRKIDRL; YRKILRQRK; IIAIVV<br>WSIIIEYR; IIAIVVWSI; AIVVWSIVIIEYR; IVVWSIVII; IIEYRKILRQR<br>KIDR; EYRKILRQR; IIEYRKILRQRKIDR; YRKILRQRK; IIIAIVVWSIVII<br>EY; IIAIVVWSI; IIIAIVVWSIVIIEY; IVVWSIVII; ILRQRKIDRLIDRLI; ILR<br>QRKIDR; IPIVAIVALVVAIII; IVAIVALVV; IPIVAIVALVVAIII; VAIVALVV<br>A; ISALVEMGVEMGHHA; LVEMGVEMG; IVAIVALVVAIIIAI; IVAIVALV<br>V; IVAIVALVVAIIIAI; IVALVVAII; IVAIVALVVAIIIAI; VAIVALVVA; IVALV<br>VAIIIAIVW; LVVAIIIAI; IVALVVAIIIAIVW; VAIIIAIVV; IVIIEYRKILRQ<br>RKI; IIEYRKILR; IVIIEYRKILRQRKI; YRKILRQRK; IVVWSIVIIEYRKIL;<br>IVVWSIVII; KILRQRKIDRLIDRL; ILRQRKIDR; KILRQRKIDRLIDRL; L<br>RQRKIDRL; LVVAIIIAIVVWSIV; IIAIVVWSI; LVVAIIIAIVVWSIV; IIIAIV<br>VWS; LVVAIIIAIVVWSIV; VAIIIAIVV; MGVEMGHHAPWDVDD; MGHH<br>APWDV; MQPIPIVAIVALVVA; IPIVAIVAL; MQPIPIVAIVALVVA; IVAIV<br>ALVV; PIPIVAIVALVVAII; IVAIVALVV; PIPIVAIVALVVAII; VAIVALVVA;<br>PIVAIVALVVAIIIA; IVAIVALVV; PIVAIVALVVAIIIA; VAIVALVVA; QPIP<br>IVAIVALVVAI; IVAIVALVV; QPIPIVAIVALVVAI; VAIVALVVA; RKILRQ<br>RKIDRLIDR; ILRQRKIDR; RKILRQRKIDRLIDR; LRQRKIDRL; SALVE<br>MGVEMGHHAP; LVEMGVEMG; SIVIIEYRKILRQRK; IEYRKILRQ; SI<br>VIIEYRKILRQRK; IIEYRKILR; SIVIIEYRKILRQRK; VIIEYRKIL; VAIIIAI<br>VVWSIVII; AIVVWSIVI; VAIIIAIVVWSIVII; IAIVVWSIV; VAIIIAIVVWSIV<br>II; IIAIVVWSI; VAIIIAIVVWSIVII; IIIAIVVWS; VAIVALVVAIIIAIV; IVALVV<br>AII; VAIVALVVAIIIAIV; LVVAIIIAI; VALVVAIIIAIVVWS; LVVAIIIAI; VALV<br>VAIIIAIVVWS; VAIIIAIVV; VALVVAIIIAIVVWS; VVAIIIAIV; VEMGVEM<br>GHHAPWDV; MGVEMGHHA; VIIEYRKILRQRKID; EYRKILRQR; VIIE<br>YRKILRQRKID; YRKILRQRK; VVAIIIAIVVWSIVI; IIAIVVWSI; VVAIIIAI<br>VVWSIVI; IIIAIVVWS; VVWSIVIIEYRKILR; WSIVIIEYR; VWSIVIIEYRK<br>ILRQ; IIEYRKILR; WSIVIIEYRKILRQR; IIEYRKILR; YRKILRQRKIDRLI<br>D; ILRQRKIDR; YRKILRQRKIDRLID; LRQRKIDRL; YRKILRQRKIDRLI<br>D; YRKILRQRK | |
| NP_057854<br>Rev | 8-mers:<br>ELIRTVRL; LIRTVRLI; RTVRLIKL; RLIKLLYQ; RQARRNRR; QARRNR<br>RR; RRNRRRRW; RNRRRRWR; RRRRWRER; RRWRERQR; RQRQI<br>HSI; RQIHSISE; QIHSISER; SERILGTY; ILGTYLGR; RSAEPVPL; AEP<br>VPLQL; VPLQLPPL; LQLPPLER; QLPPLERL; LPPLERLT; PPLERLTL;<br>GTSGTQGV; VGSPQILV; ILVESPTV; TVLESGTK<br>9-mers:<br>EELIRTVRL; ELIRTVRLI; LIRTVRLIK; TVRLIKLLY; RLIKLLYQS; GTR<br>QARRNR; RQARRNRRR; QARRNRRRR; RRNRRRRWR; NRRRRW<br>RER; RRRRWRERQ; RRRWRERQR; RRWRERQRQ; RQIHSISER; QI<br>HSISERI; IHSISERIL; SISERILGT; ISERILGTY; SERILGTYL; RILGTYL<br>GR; ILGTYLGRS; YLGRSAEPV; SAEPVPLQL; PVPLQLPPL; LQLPPL<br>ERL; QLPPLERLT; LPPLERLTL; CGTSGTQGV; TQGVGSPQI; GVGS<br>PQILV; QILVESPTV; ILVESPTVL<br>10-mers:<br>DSDEELIRTV; DEELIRTVRL; ELIRTVRLIK; LIRTVRLIKL; RTVRLIKLL<br>Y; GTRQARRNRR; TRQARRNRRR; RQARRNRRRR; ARRNRRRRW<br>R; RNRRRRWRER; RRRRWRERQR; RRWRERQRQI; RERQRQIHSI;<br>RQIHSISERI; SISERILGTY; ERILGTYLGR; ILGTYLGRSA; TYLGRSA<br>EPV; RSAEPVPLQL; EPVPLQLPPL; PLQLPPLERL; LQLPPLERLT; Q<br>LPPLERLTL; TLDCNEDCGT; QGVGSPQILV; PQILVESPTV<br>11-mers:<br>DSDEELIRTVR; ELIRTVRLIKL; LIRTVRLIKLL; GTRQARRNRRR; QA<br>RRNRRRRWR; RRNRRRRWRER; RRRRWRERQRQ; RRRWRERQ<br>RQI; RRWRERQRQIH; RQRQIHSISER; RQIHSISERIL; HSISERILGT<br>Y; SISERILGTYL; RILGTYLGRSA; GTYLGRSAEPV; YLGRSAEPVPL;<br>AEPVPLQLPPL; VPLQLPPLERL; LQLPPLERLTL; TQGVGSPQILV; E<br>SPTVLESGTK<br>15-mer + 9-mer core:<br>AEPVPLQLPPLERLT; LQLPPLERL; AEPVPLQLPPLERLT; VPLQLP<br>PLE; ARRNRRRRWRERQRQ; NRRRRWRER; DEELIRTVRLIKLLY; I<br>RTVRLIKL; DSDEELIRTVRLIKL; EELIRTVRL; DSDEELIRTVRLIKL; LI<br>RTVRLIK; EELIRTVRLIKLLYQ; IRTVRLIKL; EELIRTVRLIKLLYQ; LIR | 6045-6355 |

| Protein accession no/ name | Antigenic peptides | SEQ ID NO |
|---|---|---|
| | TVRLIK; EELIRTVRLIKLLYQ; TVRLIKLLY; EGTRQARRNRRRRWR; RQARRNRRR; EGTRQARRNRRRRWR; TRQARRNRR; ELIRTVRLIK LLYQS; IRTVRLIKL; ELIRTVRLIKLLYQS; TVRLIKLLY; ELIRTVRLIKL LYQS; VRLIKLLYQ; EPVPLQLPPLERLTL; LQLPPLERL; EPVPLQLPP LERLTL; VPLQLPPLE; ERILGTYLGRSAEPV; ILGTYLGRS; ERILGTY LGRSAEPV; LGTYLGRSA; GRSAEPVPLQLPPLE; GRSAEPVPL; GR SAEPVPLQLPPLE; PVPLQLPPL; GSPQILVESPTVLES; ILVESPTVL; GSPQILVESPTVLES; LVESPTVLE; GTRQARRNRRRRWRE; RQAR RNRRR; GTYLGRSAEPVPLQL; YLGRSAEPV; GVGSPQILVESPTVL; PQILVESPT; HSISERILGTYLGRS; ERILGTYLG; IKLLYQSNPPPNP EG; LLYQSNPPP; IKLLYQSNPPPNPEG; LYQSNPPPN; IKLLYQSNP PPNPEG; YQSNPPPNP; ILGTYLGRSAEPVPL; ILGTYLGRS; ILGTYL GRSAEPVPL; YLGRSAEPV; ILVESPTVLESGTKE; ILVESPTVL; ILVE SPTVLESGTKE; LVESPTVLE; IRTVRLIKLLYQSNP; IRTVRLIKL; IRT VRLIKLLYQSNP; TVRLIKLLY; IRTVRLIKLLYQSNP; VRLIKLLYQ; ISE RILGTYLGRSAE; ERILGTYLG; ISERILGTYLGRSAE; ILGTYLGRS; IS ERILGTYLGRSAE; LGTYLGRSA; KLLYQSNPPPNPEGT; LYQSNPP PN; KLLYQSNPPPNPEGT; YQSNPPPNP; LGTYLGRSAEPVPLQ; YL GRSAEPV; LIKLLYQSNPPPNPE; LLYQSNPPP; LIKLLYQSNPPPNP E; LYQSNPPPN; LIKLLYQSNPPPNPE; YQSNPPPNP; LIRTVRLIKLL YQSN; IRTVRLIKL; LIRTVRLIKLLYQSN; TVRLIKLLY; LIRTVRLIKLLY QSN; VRLIKLLYQ; LLYQSNPPPNPEGTR; YQSNPPPNP; LPPLERLT LDCNEDC; LERLTLDCN; LQLPPLERLTLDCNE; LERLTLDCN; LQLP PLERLTLDCNE; LQLPPLERL; LYQSNPPPNPEGTRQ; YQSNPPPNP; NPEGTRQARRNRRRR; TRQARRNRR; NRRRRWRERQRQIHS; RR RWRERQR; NRRRRWRERQRQIHS; WRERQRQIH; PEGTRQARRN RRRRW; TRQARRNRR; PLQLPPLERLTLDCN; LQLPPLERL; PNPEG TRQARRNRRR; TRQARRNRR; PPLERLTLDCNEDCG; LERLTLDCN; PPNPEGTRQARRNRR; EGTRQARRN; PQILVESPTVLESGT; ILVES PTVL; PQILVESPTVLESGT; LVESPTVLE; PVPLQLPPLERLTLD; LQL PPLERL; PVPLQLPPLERLTLD; VPLQLPPLE; QARRNRRRRWRERQ R; NRRRRWRER; QILVESPTVLESGTK; LVESPTVLE; QLPPLERLTL DCNED; LERLTLDCN; RILGTYLGRSAEPVP; ILGTYLGRS; RILGTYL GRSAEPVP; YLGRSAEPV; RLIKLLYQSNPPPNP; LIKLLYQSN; RLIK LLYQSNPPPNP; LLYQSNPPP; RLIKLLYQSNPPPNP; LYQSNPPPN; RNRRRRWRERQRQIH; RRRWRERQR; RQARRNRRRRWRERQ; N RRRRWRER; RQARRNRRRRWRERQ; RRNRRRRWR; RRNRRRR WRERQRQI; NRRRRWRER; RRRRWRERQRQIHSI; WRERQRQIH; RRRWRERQRQIHSIS; WRERQRQIH; RRWRERQRQIHSISE; WRER QRQIH; RSAEPVPLQLPPLER; VPLQLPPLE; RTVRLIKLLYQSNPP; I KLLYQSNP; RTVRLIKLLYQSNPP; VRLIKLLYQ; SAEPVPLQLPPLER L; PVPLQLPPL; SAEPVPLQLPPLERL; VPLQLPPLE; SDEELIRTVRLI KLL; IRTVRLIKL; SERILGTYLGRSAEP; ILGTYLGRS; SERILGTYLGR SAEP; LGTYLGRSA; SISERILGTYLGRSA; ERILGTYLG; SISERILGT YLGRSA; ILGTYLGRS; SPQILVESPTVLESG; ILVESPTVL; SPQILVE SPTVLESG; LVESPTVLE; TRQARRNRRRRWRER; RRNRRRRWR; T VRLIKLLYQSNPPP; IKLLYQSNP; TVRLIKLLYQSNPPP; VRLIKLLYQ; TYLGRSAEPVPLQLP; YLGRSAEPV; VGSPQILVESPTVLE; ILVESP TVL; VGSPQILVESPTVLE; VGSPQILVE; VPLQLPPLERLTLDC; LQL PPLERL; VPLQLPPLERLTLDC; VPLQLPPLE; VRLIKLLYQSNPPPN; LLYQSNPPP; YLGRSAEPVPLQLPP; YLGRSAEPV; YQSNPPPNPE GTRQA; YQSNPPPNP | |
| NP_057855 Vpu | 8-mer EPHNEWTL; HNEWTLEL; NEWTLELL; TLELLEEL; EELKNEAV; ELKN EAVR; EAVRHFPR; AVRHFPRI; GQHIYETY; ETYGDTWA; YGDTWA GV; DTWAGVEA; TWAGVEAI; VEAIIRIL; RILQQLLF; ILQQLLFI; QQLL FIHF; QLLFIHFR; LLFIHFRI; RIGCRHSR; HSRIGVTR; RIGVTRQR; VT RQRRAR; RARNGASR<br>9-mer REPHNEWTL; PHNEWTLEL; WTLELLEEL; TLELLEELK; LLEELKNE A; NEAVRHFPR; EAVRHFPRI; FPRIWLHGL; WLHGLGQHI; GLGQHI YET; IYETYGDTW; YETYGDTWA; ETYGDTWAG; TYGDTWAGV; DT WAGVEAI; TWAGVEAII; AIIRILQQL; IRILQQLLF; RILQQLLFI; LQQLL FIHF; QQLLFIHFR; QLLFIHFRI; FIHFRIGCR; FRIGCRHSR; RIGCRHS RI; RHSRIGVTR; SRIGVTRQR; RIGVTRQRR; GVTRQRRAR; RQRRA RNGA; RRARNGASR<br>10-mer QAPEDQGPQR; EPHNEWTLEL; WTLELLEELK; ELLEELKNEA; LLEE LKNEAV; ELKNEAVRHF; KNEAVRHFPR; EAVRHFPRIW; AVRHFPRI WL; HFPRIWLHGL; FPRIWLHGLG; IWLHGLGQHI; WLHGLGQHIY; G LGQHIYETY; HIYETYGDTW; ETYGDTWAGV; DTWAGVEAII; TWAG VEAIIR; EAIIRILQQL; AIIRILQQLL; ILQQLLFIHF; LQQLLFIHFR; QQLL FIHFRI; LLFIHFRIGC; LFIHFRIGCR; HFRIGCRHSR; FRIGCRHSRI; C RHSRIGVTR; HSRIGVTRQR; SRIGVTRQRR; QRRARNGASR | 6356-6574 |

| Protein accession no/name | Antigenic peptides | SEQ ID NO |
|---|---|---|
| | 11-mer<br>EQAPEDQGPQR; REPHNEWTLEL; EPHNEWTLELL; NEWTLELLEE L; ELLEELKNEAV; EELKNEAVRHF; EAVRHFPRIWL; RHFPRIWLHG L; RIWLHGLGQHI; IWLHGLGQHIY; WLHGLGQHIYE; HIYETYGDTW A; YETYGDTWAGV; ETYGDTWAGVE; DTWAGVEAIIR; TWAGVEAII RI; VEAIIRILQQL; EAIIRILQQLL; AIIRILQQLLF; IIRILQQLLFI; RILQQL LFIHF; ILQQLLFIHFR; LQQLLFIHFRI; QLLFIHFRIGC; LLFIHFRIGCR; IHFRIGCRHSR; RIGCRHSRIGV; GCRHSRIGVTR; HSRIGVTRQRR; RIGVTRQRRAR; RQRRARNGASR<br>15-mer + 9-mer core<br>AGVEAIIRILQQLLF; VEAIIRILQ; AIIRILQQLLFIHFR; ILQQLLFIH; AIIR ILQQLLFIHFR; IRILQQLLF; AIIRILQQLLFIHFR; LQQLLFIHF; DTWAG VEAIIRILQQ; WAGVEAIIR; EAIIRILQQLLFIHF; IIRILQQLL; EAIIRILQ QLLFIHF; ILQQLLFIH; EAIIRILQQLLFIHF; IRILQQLF; EAVRHFPRI WLHGLG; VRHFPRIWL; EELKNEAVRHFPRIW; LKNEAVRHF; ELKN EAVRHFPRIWL; LKNEAVRHF; ELKNEAVRHFPRIWL; NEAVRHFPR; ELLEELKNEAVRHFP; LKNEAVRHF; ETYGDTWAGVEAIIR; DTWAG VEAI; FIHFRIGCRHSRIGV; FIHFRIGCR; FPRIWLHGLGQHIYE; IWLH GLGQH; GDTWAGVEAIIRILQ; WAGVEAIIR; GVEAIIRILQQLLFI; IRILQQLLF; HFPRIWLHGLGQHIY; I WLHGLGQH; HFPRIWLHGLGQHIY; WLHGLGQHI; IIRILQQLLFIHFR I; ILQQLLFIH; IIRILQQLLFIHFRI; IRILQQLLF; LQQ LLFIHF; ILQQLLFIHFRIGCR; ILQQLLFIH; ILQQLLFIHFRIGCR; LLFIH FRIG; IRILQQLLFIHFRIG; ILQQLLFIH; IRILQQLLFIHFRIG; IRILQQLL F; KNEAVRHFPRIWLHG; VRHFPRIWL; LEELKNEAVRHFPRI; LKNE AVRHF; LELLEELKNEAVRHF; ELKNEAVRH; LELLEELKNEAVRHF; LEELKNEAV; LFIHFRIGCRHSRIG; FIHFRIGCR; LKNEAVRHFPRIW LH; LKNEAVRHF; LKNEAVRHFPRIWLH; VRHFPRIWL; LLEELKNEA VRHFPR; LKNEAVRHF; LLFIHFRIGCRHSRI; FIHFRIGCR; LQQLLFI HFRIGCRH; FIHFRIGCR; NEAVRHFPRIWHGL; VRHFPRIWL; PRIW LHGLGQHIYET; WLHGLGQHI; QLLFIHFRIGCRHSR; FIHFRIGCR; Q QLLFIHFRIGCRHS; FIHFRIGCR; RHFPRIWLHGLGQHI; FPRIWLHG L; RHFPRIWLHGLGQHI; IWLHGLGQH; RILQQLLFIHFRIGC; ILQQLL FIH; RIWLHGLGQHIYETY; WLHGLGQHI; TYGDTWAGVEAIIRI; WAG VEAIIR; VEAIIRILQQLLFIH; IRILQQLLF; VRHFPRIWLHGLGQH; FPRI WLHGL; WAGVEAIIRILQQLL; WAGVEAIIR; YGDTWAGVEAIIRIL; WA GVEAIIR | |
| NP_057856<br>Envelope surface glycoprotein gp160 precursor | 8-mer<br>RVKEKYQH; KEKYQHLW; EKYQHLWR; KYQHLWRW; HLWRWGWR; WGWRWGTM; WRWGTMLL; TMLLGMLM; MLLGMLMI; LLGMLMIC; GMLMICSA; MLMICSAT; MICSATEK; CSATEKLW; SATEKLWV; EKL WVTVY; KLWVTVYY; WVTVYYGV; TVYYGVPV; VYYGVPVV; YYGV PVWK; VPVWKEAT; KEATTTLF; TTTLFCAS; TLFCASDA; CASDAKA Y; YDTEVHNV; DTEVHNVW; EVHNVWAT; NVWATHAC; VWATHACV; NPQEVVLV; QEVVLVNV; EVVLVNVT; NVTENFNM; VTENFNMW; TE NFNMWK; NMWKNDMV; MHEDIISL; SLWDQSLK; QSLKPCVK; SLKP CVKL; KLTPLCVS; LTPLCVSL; TPLCVSLK; SLKCTDLK; NTNSSSGR; SGRMIMEK; MIMEKGEI; GEIKNCSF; FNISTSIR; ISTSIRGK; STSIRG KV; SIRGKVQK; KVQKEYAF; VQKEYAFF; KEYAFFYK; EYAFFYKL; F FYKLDII; YKLDIIPI; IPIDNDTT; LTSCNTSV; NTSVITQA; VITQACPK; IT QACPKV; FEPIPIHY; IPIHYCAP; HYCAPAGF; YCAPAGFA; CAPAGF AI; APAGFAIL; AILKCNNK; GTGPCTNV; TVQCTHGI; VQCTHGIR; CT HGIRPV; GIRPVVST; RPVVSTQL; VVSTQLLL; QLLLNGSL; LLLNGSL A; SLAEEEVV; EEVVIRSV; VVIRSVNF; SVNFTDNA; FTDNAKTI; IVQL NTSV; QLNTSVEI; SVEINCTR; RKRIRIQR; RIQRGPGR; RGPGRAFV; RAFVTIGK; QAHCNISR; RAKWNNTL; TLKQIASK; KQIASKLR; NNKTI IFK; PEIVTHSF; SFNCGGEF; GEFFYCNS; FYCNSTQL; QLFNSTWF; STWFNSTW; EGSDTITL; DTITLPCR; TITLPCRI; ITLPCRIK; LPCRIKQ I; RIKQIINM; KQIINMWQ; QIINMWQK; IINMWQKV; WQKVGKAM; KVG KAMYA; KAMYAPPI; APPISGQI; QIRCSSNI; CSSNITGL; ITGLLLTR; N NESEIFR; WRSELYKY; RSELYKYK; ELYKYKVV; LYKYKVVK; KVVKI EPL; EPLGVAPT; GVAPTKAK; RRVVQREK; RVVQREKR; REKRAVGI; RAVGIGAL; FLGFLGAA; FLGAAGST; STMGAASM; MGAASMTL; AA SMTLTV; SMTLTVQA; MTLTVQAR; TVQARQLL; RQLLSGIV; QLLSGI VQ; LLSGIVQQ; VQQQNNLL; QQQNNLLR; QQNNLLRA; NLLRAIEA; L LRAIEAQ; AIEAQQHL; IEAQQHLL; AQQHLLQL; HLLQLTVW; LQLTV WGI; QLTVWGIK; TVWGIKQL; GIKQLQAR; KQLQARIL; QLQARILA; L QARILAV; ILAVERYL; LAVERYLK; RYLKDQQL; YLKDQQLL; QLLGIW GC; GIWGCSGK; KLICTTAV; TTAVPWNA; AVPWNASW; VPWNASW S; QIWNHTTVV; TTWMEWDR; WMEWDREI; WDREINNY; EINNYTSL; YTSLIHSL; ESQNQQEK; QEKNEQEL; NEQELLEL; LLELDKWA; ELD KWASL; KWASLWNW; WASLWNWF; SLWNWFNI; NWFNITNW; WFN ITNWL; FNITNWLW; NITNWLWY; ITNWLWYI; NWLWYIKL; WLWYIKL F; LWYIKLFI; WYIKLFIM; YIKLFIMI; FIMIVGGL; IMIVGGLV; IVGGLVG | 6575-9108 |

| Protein accession no/ name | Antigenic peptides | SEQ ID NO |
|---|---|---|
| | L; GLVGLRIV; GLRIVFAV; IVFAVLSI; AVLSIVNR; VLSIVNRV; LSIVNR VR; VRQGYSPL; SPLSFQTH; PLSFQTHL; FQTHLPTP; QTHLPTPR; L PTPRGPD; RDRDRSIR; RLVNGSLA; LVNGSLAL; ALIWDDLR; RSLCL FSY; LCLFSYHR; CLFSYHRL; LFSYHRLR; SYHRLRDL; RLRDLLLI; D LLLIVTR; LLLIVTRI; LLIVTRIV; IVTRIVEL; RIVELLGR; IVELLGRR; GR RGWEAL; RRGWEALK; WEALKYWW; ALKYWWNL; YWWNLLQY; NL LQYWSQ; LQYWSQEL; QYWSQELK; SLLNATAI; LLNATAIA; NATAIA VA; AVAEGTDR; AEGTDRVI; GTDRVIEV; EVVQGACR; RAIRHIPR; AI RHIPRR; RHIPRRIR; IPRRIRQG; RIRQGLER 9-mer RVKEKYQHL; KEKYQHLWR; YQHLWRWGW; HLWRWGWRW; WR WGWRWGT; WGWRWGTML; GWRWGTMLL; TMLLGMLMI; MLLGM LMIC; LGMLMICSA; LMICSATEK; MICSATEKL; ICSATEKLW; ATEKL WVTV; TEKLWVTVY; EKLWVTVYY; KLWVTVYYG; LWVTVYYGV; VT VYYGVPV; TVYYGVPVW; VYYGVPVWK; VPVWKEATT; VWKEATTT L; EATTTLFCA; TLFCASDAK; FCASDAKAY; AYDTEVHNV; TEVHNV WAT; EVHNVWATH; NVWATHACV; PTDPNPQEV; DPNPQEVVL; VL VNVTENF; VTENFNMWK; FNMWKNDMV; QMHEDIISL; IISLWDQSL; ISLWDQSLK; SLWDQSLKP; SLKPCVKLT; KPCVKLTPL; KLTPLCVSL; LTPLCVSLK; VSLKCTDLK; TNTNSSSGR; NTNSSSGRM; SSGRMIM EK; RMIMEKGEI; MIMEKGEIK; EIKNCSFNI; CSFNISTSI; SFNISTSIR; NISTSIRGK; ISTSIRGKV; TSIRGKVQK; KVQKEYAFF; VQKEYAFFY; KEYAFFYKL; AFFYKLDII; FYKLDIIPI; IPIDNDTTS; PIDNDTTSY; KLTS CNTSV; LTSCNTSVI; NTSVITQAC; SVITQACPK; VITQACPKV; TQAC PKVSF; CPKVSFEPI; KVSFEPIPI; SFEPIPIHY; EPIPIHYCA; IPIHYCA PA; YCAPAGFAI; CAPAGFAIL; APAGFAILK; FAILKCNNK; ILKCNNKT F; NGTGPCTNV; STVQCTHGI; TVQCTHGIR; CTHGIRPVV; RPVVST QLL; TQLLLNGSL; QLLLNGSLA; LLLNGSLAE; LLNGSLAEE; SLAEEE VVI; EVVIRSVNF; SVNFTDNAK; NAKTIIVQL; IIVQLNTSV; VQLNTSV EI; TSVEINCTR; CTRPNNNTR; RPNNNTRKR; IQRGPGRAF; QRGPG RAFV; GPGRAFVTI; GRAFVTIGK; VTIGKIGNM; TIGKIGNMR; NMRQ AHCNI; RQAHCNISR; QAHCNISRA; HCNISRAKW; SRAKWNNTL; RA KWNNTLK; NTLKQIASK; TLKQIASKL; IASKLREQF; GNNKTIIFK; KQS SGGDPE; DPEIVTHSF; HSFNCGGEF; SFNCGGEFF; FNCGGEFFY; GEFFYCNST; FFYCNSTQL; FYCNSTQLF; STQLFNSTW; TQLFNST WF; QLFNSTWFN; NSTWFNSTW; TEGSDTITL; DTITLPCRI; TITLPC RIK; TLPCRIKQI; LPCRIKQII; KQIINMWQK; QIINMWQKV; NMWQKV GKA; MWQKVGKAM; WQKVGKAMY; YAPPISGQI; GQIRCSSNI; RCS SNITGL; CSSNITGLL; NITGLLLTR; NSNNESEIF; SNNESEIFR; MRDN WRSEL; NWRSELYKY; WRSELYKYK; ELYKYKVVK; LYKYKVVKI; VV KIEPLGV; EPLGVAPTK; GVAPTKAKR; APTKAKRRV; KAKRRVVQR; KRRVVQREK; RRVVQREKR; VVQREKRAV; RAVGIGALF; AVGIGAL FL; IGALFLGFL; ALFLGFLGA; FLGAAGSTM; GAAGSTMGA; STMGA ASMT; TMGAASMTL; MGAASMTLT; GAASMTLTV; SMTLTVQAR; TL TVQARQL; LTVQARQLL; QARQLLSGI; QLLSGIVQQ; LLSGIVQQQ; G IVQQQNNL; VQQQNNLLR; QQQNNLLRA; QQNNLLRAI; NLLRAIEAQ; RAIEAQQHL; AIEAQQHLL; EAQQHLLQL; AQQHLLQLT; QQHLLQLT V; HLLQLTVWG; LLQLTVWGI; LQLTVWGIK; LTVWGIKQL; TVWGIKQ LQ; GIKQLQARI; KQLQARILA; QLQARILAV; QARILAVER; RILAVERY L; ILAVERYLK; RYLKDQQLL; YLKDQQLLG; QQLLGIWGC; GIWGCS GKL; IWGCSGKLI; CTTAVPWNA; TTAVPWNAS; TAVPWNASW; VPW NASWSN; KSLEQIWNH; QIWNHTTWM; HTTWMEWDR; TWMEWDR EI; REINNYTSL; EINNYTSLI; NYTSLIHSL; YTSLIHSLI; SLIEESQNQ; Q EKNEQELL; ELLELDKWA; LELDKWASL; KWASLWNWF; SLWNWFN IT; NWFNITNWL; WFNITNWLW; FNITNWLWY; NITNWLWYI; ITNWL WYIK; NWLWYIKLF; WLWYIKLFI; WYIKLFIMI; YIKLFIMIV; FIMIVGGL V; MIVGGLVGL; IVGGLVGLR; GLVGLRIVF; LVGLRIVFA; VGLRIVFA V; GLRIVFAVL; RIVFAVLSI; IVFAVLSIV; FAVLSIVNR; AVLSIVNRV; VL SIVNRVR; IVNRVRQGY; VRQGYSPLSF; RQGYSPLSF; SPLSFQTHL; FQTHLPTPR; RDRDRSIRL; SIRLVNGSL; RLVNGSLAL; LVNGSLALI; SLALIWDDL; LALIWDDLR; LIWDDLRSL; RSLCLFSYH; SLCLFSYHR; CLFSYHRLR; SYHRLRDLL; YHRLRDLLL; RLRDLLLIV; RDLLLIVTR; DLLLIVTRI; LLLIVTRIV; LIVTRIVEL; IVTRIVELL; RIVELLGRR; VELLG RRGW; LLGRRGWEA; GRRGWEALK; RRGWEALKY; RGWEALKYW; EALKYWWNL; ALKYWWNLL; KYWWNLLQY; YWWNLLQYW; LLQY WSQEL; LQYWSQELK; SQELKNSAV; ELKNSAVSL; LKNSAVSLL; SA VSLLNAT; SLLNATAIA; LLNATAIAV; TAIAVAEGT; IAVAEGTDR; AVA EGTDRV; EGTDRVIEV; GTDRVIEVV; RVIEVVQGA; EVVQGACRA; V QGACRAIR; RAIRHIPRR; AIRHIPRRI; IPRRIRQGL; RRIRQGLER; RI RQGLERI; RQGLERILL 10-mer RVKEKYQHLW; KEKYQHLWRW; KYQHLWRWGW; YQHLWRWGW R; HLWRWGWRWG; WRWGWRWGTM; RWGWRWGTML; WGRWG GTMLL; WRWGTMLLGM; RWGTMLLGML; TMLLGMLMIC; MLLGML MICS; LLGMLMICSA; MLMICSATEK; LMICSATEKL; SATEKLWVTV; | |

-continued

| Protein accession no/ name | Antigenic peptides | SEQ ID NO |
|---|---|---|
| | ATEKLWVTVY; TEKLWVTVYY; KLWVTVYYGV; WVTVYYGVPV; VTV | |
| | YYGVPVW; TVYYGVPVWK; VPVWKEATTT; PVWKEATTTL; VWKEA | |
| | TTTLF; TTTLFCASDA; TTLFCASDAK; TLFCASDAKA; LFCASDAKAY; | |
| | KAYDTEVHNV; AYDTEVHNVW; EVHNVWATHA; HNVWATHACV; P | |
| | TDPNPQEVV; DPNPQEVVLV; NPQEVVLVNV; VVLVNVTENF; NVTE | |
| | NFNMWK; NMWKNDMVEQ; EQMHEDIISL; DIISLWDQSL; IISLWDQS | |
| | LK; SLWDQSLKPC; KLTPLCVSLK; CVSLKCTDLK; DTNTNSSSGR; N | |
| | TNSSSGRMI; SSSGRMIMEK; RMIMEKGEIK; GEIKNCSFNI; NCSFNI | |
| | STSI; CSFNISTSIR; NISTSIRGKV; STSIRGKVQK; SIRGKVQKEY; RG | |
| | KVQKEYAF; KVQKEYAFFY; VQKEYAFFYK; EYAFFYKLDI; FFYKLDII | |
| | PI; IPIDNDTTSY; YKLTSCNTSV; KLTSCNTSVI; TSVITQACPK; SVITQ | |
| | ACPKV; ITQACPKVSF; VSFEPIPIHY; EPIPIHYCAP; IPIHYCAPAG; H | |
| | YCAPAGFAI; YCAPAGFAIL; CAPAGFAILK; FAILKCNNKT; AILKCNN | |
| | KTF; TGPCTNVSTV; STVQCTHGIR; VQCTHGIRPV; GIRPVVSTQL; R | |
| | PVVSTQLLL; STQLLLNGSL; TQLLLNGSLA; LLLNGSLAEE; LNGSLA | |
| | EEEV; SLAEEEVVIR; AEEEVVIRSV; EEVVIRSVNF; EVVIRSVNFT; R | |
| | SVNFTDNAK; FTDNAKTIIV; TIIVQLNTSV; NTSVEINCTR; CTRPNNN | |
| | TRK; RPNNNTRKRI; NTRKRIRIQR; RIRIQRGPGR; RIQRGPGRAF; IQ | |
| | RGPGRAFV; PGRAFVTIGK; FVTIGKIGNM; VTIGKIGNMR; MRQAHC | |
| | NISR; RQAHCNISRA; QAHCNISRAK; SRAKWNNTLK; NTLKQIASKL; | |
| | TLKQIASKLR; QIASKLREQF; KLREQFGNNK; REQFGNNKTI; QFGN | |
| | NKTIIF; FGNNKTIIFK; KQSSGGDPEI; HSFNCGGEFF; SFNCGGEFF | |
| | Y; EFFYCNSTQL; FFYCNSTQLF; NSTQLFNSTW; STQLFNSTWF; QL | |
| | FNSTWFNS; STWFNSTWST; GSDTITLPCR; DTITLPCRIK; TLPCRIK | |
| | QII; LPCRIKQIIN; RIKQIINMWQ; KQIINMWQKV; IINMWQKVGK; NMW | |
| | QKVGKAM; MWQKVGKAMY; WQKVGKAMYA; AMYAPPISGQ; MYA | |
| | PPISGQI; YAPPISGQIR; NSNNESEIFR; EIFRPGGGDM; DMRDNWR | |
| | SEL; MRDNWRSELY; RDNWRSELYK; SELYKYKVVK; ELYKYKVVKI; | |
| | KYKVVKIEPL; KVVKIEPLGV; EPLGVAPTKA; GVAPTKAKRR; APTKA | |
| | KRRVV; TKAKRRVVQR; AKRRVVQREK; KRRVVQREKR; RVVQREK | |
| | RAV; KRAVGIGALF; RAVGIGALFL; GIGALFLGFL; ALFLGFLGAA; FL | |
| | GFLGAAGS; FLGAAGSTMG; LGAAGSTMGA; GAAGSTMGAA; STM | |
| | GAASMTL; TMGAASMTLT; MGAASMTLTV; ASMTLTVQAR; SMTLTV | |
| | QARQ; MTLTVQARQL; TLTVQARQLL; VQARQLLSGI; QLLSGIVQQQ; | |
| | GIVQQQNNLL; IVQQQNNLLR; VQQQNNLLRA; QQQNNLLRAI; NLL | |
| | RAIEAQQ; RAIEAQQHLL; IEAQQHLLQL; AQQHLLQLTV; HLLQLTV | |
| | WGI; LLQLTVWGIK; QLTVWGIKQL; TVWGIKQLQA; VWGIKQLQAR; | |
| | KQLQARILAV; LQARILAVER; RILAVERYLK; VERYLKDQQL; YLKDQ | |
| | QLLGI; LLGIWGCSGK; GIWGCSGKLI; KLICTTAVPW; CTTAVPWNA | |
| | S; TTAVPWNASW; SWSNKSLEQI; WSNKSLEQIW; SLEQIWNHTT; E | |
| | QIWNHTTWM; IWNHTTWMEW; TTWMEWDREI; MEWDREINNY; RE | |
| | INNYTSLI; NYTSLIHSLI; SLIHSLIEES; SLIEESQNQQ; ELLELDKWAS; | |
| | LLELDKWASL; WASLWNWFNI; SLWNWFNITN; LWNWFNITNW; N | |
| | WFNITNWLW; WFNITNWLWY; FNITNWLWYI; NITNWLWYIK; ITNWL | |
| | WYIKL; NWLWYIKLFI; WLWYIKLFIM; LWYIKLFIMI; WYIKLFIMIV; KLF | |
| | IMIVGGL; IMIVGGLVGL; MIVGGLVGLR; GLVGLRIVFA; LVGLRIVFA | |
| | V; RIVFAVLSIV; VFAVLSIVNR; FAVLSIVNRV; AVLSIVNRVR; SIVNRV | |
| | RQGY; RVRQGYSPLS; VRQGYSPLSF; SFQTHLPTPR; ERDRDRSIR | |
| | L; IRLVNGSLAL; RLVNGSLALI; LVNGSLALIW; SLALIWDDLR; ALIWD | |
| | DLRSL; LIWDDLRSLC; DLRSLCLFSY; RSLCLFSYHR; SLCLFSYHRL; | |
| | LCLFSYHRLR; FSYHRLRDLL; SYHRLRDLLL; RLRDLLLIVT; DLLLIV | |
| | TRIV; LLIVTRIVEL; LIVTRIVELL; VTRIVELLGR; ELLGRRGWEA; LLG | |
| | RRGWEAL; LGRRGWEALK; GRRGWEALKY; RGWEALKYWW; WEA | |
| | LKYWWNL; EALKYWWNLL; LKYWWNLLQY; KYWWNLLQYW; NLLQ | |
| | YWSQEL; LLQYWSQELK; WSQELKNSAV; QELKNSAVSL; ELKNSA | |
| | VSLL; SLLNATAIAV; LLNATAIAVA; IAVAEGTDRV; AVAEGTDRVI; AE | |
| | GTDRVIEV; EGTDRVIEVV; EVVQGACRAI; VVQGACRAIR; ACRAIR | |
| | HIPR; AIRHIPRRIR; HIPRRIRQGL; RRIRQGLERI; RIRQGLERIL | |
| | 11-mer | |
| | RVKEKYQHLWR; KYQHLWRWGWR; YQHLWRWGWRW; HLWRW | |
| | GWRWGT; WRWGWRWGTML; RWGWRWGTMLL; WRWGTMLLGM | |
| | L; MLLGMLMICSA; LLGMLMICSAT; GMLMICSATEK; MLMICSATEKL; | |
| | LMICSATEKLW; MICSATEKLWV; CSATEKLWVTV; SATEKLWVTVY; | |
| | ATEKLWVTVYY; EKLWVTVYYGV; WVTVYYGVPVW; VTVYYGVPV | |
| | WK; VPVWKEATTTL; PVWKEATTTLF; TTTLFCASDAK; TTLFCASDA | |
| | KA; TLFCASDAKAY; KAYDTEVHNVW; NVWATHACVPT; CVPTDPN | |
| | PQEV; VPTDPNPQEVV; PTDPNPQEVVL; NPQEVVLVNVT; EVVLVN | |
| | VTENF; VLVNVTENFNM; LVNVTENFNMW; NMWKNDMVEQM; DMV | |
| | EQMHEDII; VEQMHEDIISL; DIISLWDQSLK; SLWDQSLKPCV; SLKP | |
| | CVKLTPL; KPCVKLTPLCV; KLTPLCVSLKC; DTNTNSSSGRM; NTNS | |
| | SSGRMIM; NSSSGRMIMEK; GRMIMEKGEIK; MEKGEIKNCSF; NCS | |
| | FNISTSIR; SFNISTSIRGK; ISTSIRGKVQK; TSIRGKVQKEY; SIRGKV | |
| | QKEYA; KVQKEYAFFYK; VQKEYAFFYKL; KEYAFFYKLDI; EYAFFY | |
| | KLDII; IIPIDNDTTSY; IPIDNDTTSYK; PIDNDTTSYKL; KLTSCNTSVIT; | |
| | NTSVITQACPK; QACPKVSFEPI; CPKVSFEPIPI; KVSFEPIPIHY; EPI | |

| Protein accession no/ name | Antigenic peptides | SEQ ID NO |
|---|---|---|
| | PIHYCAPA; IPIHYCAPAGF; HYCAPAGFAIL; AGFAILKCNNK; FAILKCNNKTF; GTGPCTNVSTV; NVSTVQCTHGI; VSTVQCTHGIR; TVQCTHGIRPV; GIRPVVSTQLL; LLLNGSLAEEE; LLNGSLAEEEV; SLAEEEVVIRS; EEEVVIRSVNF; EEVVIRSVNFT; NFTDNAKTIIV; KTIIVQLNTSV; IIVQLNTSVEI; QLNTSVEINCT; LNTSVEINCTR; CTRPNNNTRKR; RPNNNTRKRIR; NNTRKRIRIQR; KRIRIQRGPGR; RIQRGPGRAFV; IQRGPGRAFVT; FVTIGKIGNMR; NMRQAHCNISR; RQAHCNISRAK; NISRAKWNNTL; ISRAKWNNTLK; NTLKQIASKLR; KQIASKLREQF; KLREQFGNNKT; REQFGNNKTII; EQFGNNKTIIF; QFGNNKTIIFK; KQSSGGDPEIV; HSFNCGGEFFY; GEFFYCNSTQL; EFFYCNSTQLF; QLFNSTWFNST; LFNSTWFNSTW; STWSTEGSNNT; EGSDTITLPCR; LPCRIKQIINM; RIKQIINMWQK; QIINMWQKVGK; IINMWQKVGKA; NMWQKVGKAMY; KVGKAMYAPPI; AMYAPPISGQI; MYAPPISGQIR; QIRCSSNITGL; SSNITGLLLTR; SEIFRPGGGDM; EIFRPGGGDMR; RPGGGDMRDNW; DMRDNWRSELY; RSELYKYKVVK; YKYKVVKIEPL; KIEPLGVAPTK; GVAPTKAKRRV; APTKAKRRVVQ; PTKAKRRVVQR; KAKRRVVQREK; RRVVQREKRAV; REKRAVGIGAL; AVGIGALFLGF; FLGFLGAAGST; FLGAAGSTMGA; STMGAASMTLT; TMGAASMTLTV; AASMTLTVQAR; SMTLTVQARQL; MTLTVQARQLL; TVQARQLLSGI; VQARQLLSGIV; GIVQQQNNLLR; VQQQNNLLRAI; QQNNLLRAIEA; LLRAIEAQQHL; AIEAQQHLLQL; EAQQHLLQLTV; HLLQLTVWGIK; LQLTVWGIKQL; QLTVWGIKQLQ; TVWGIKQLQAR; VWGIKQLQARI; KQLQARILAVE; QLQARILAVER; LQARILAVERY; ARILAVERYLK; AVERYLKDQQL; VERYLKDQQLL; RYLKDQQLLGI; QLLGIWGCSGK; LLGIWGCSGKL; CTTAVPWNASW; TTAVPWNASWS; AVPWNASWSNK; VPWNASWSNKS; QIWNHTTWMEW; WMEWDREINNY; WDREINNYTSL; SLIHSLIEESQ; SLIEESQNQQE; QEKNEQELLEL; ELLELDKWASL; KWASLWNWFNI; WASLWNWFNIT; SLWNWFNITNW; LWNWFNITNWL; NWFNITNWLWY; WFNITNWLWYI; NITNWLWYIKL; ITNWLWYIKLF; TNWLWYIKLFI; WLWYIKLFIMI; KLFIMIVGGLV; FIMIVGGLVGL; IMIVGGLVGLR; MIVGGLVGLRI; IVGGLVGLRIV; GLVGLRIVFAV; GLRIVFAVLSI; IVFAVLSIVNR; FAVLSIVNRVR; LSIVNRVRQGY; RVRQGYSPLSF; RQGYSPLSFQT; GYSPLSFQTHL; SPLSFQTHLPT; LSFQTHLPTPR; TPRGPDRPEGI; GERDRDRSIRL; SIRLVNGSLAL; RLVNGSLALIW; GSLALIWDDLR; ALIWDDLRSLC; LIWDDLRSLCL; IWDDLRSLCLF; SLCLFSYHRLR; CLFSYHRLRDL; SYHRLRDLLLI; RLRDLLLIVTR; LLLIVTRIVEL; LLIVTRIVELL; IVTRIVELLGR; VTRIVELLGRR; ELLGRRGWEAL; LLGRRGWEALK; GWEALKYWWNL; WEALKYWWNLL; ALKYWWNLLQY; LKYWWNLLQYW; NLLQYWSQELK; SQELKNSAVSL; QELKNSAVSLL; SAVSLLNATAI; AVSLLNATAIA; SLLNATAIAVA; NATAIAVAEGT; TAIAVAEGTDR; AIAVAEGTDRV; VAEGTDRVIEV; AEGTDRVIEVV; RVIEVVQGACR; EVVQGACRAIR; GACRAIRHIPR; ACRAIRHIPRR; RAIRHIPRRIR; RRIRQGLERIL; RIRQGL

| Protein accession no/ name | Antigenic peptides | SEQ ID NO |
|---|---|---|
| | VELL; DLLLIVTRIVELLGR; LIVTRIVEL; DLLLIVTRIVELLGR; LLIVTRI VE; DLRSLCLFSYHRLRD; LRSLCLFSY; DMRDNWRSELYKYKV; WR SELYKYK; DNAKTIIVQLNTSVE; IIVQLNTSV; DNAKTIIVQLNTSVE; TI IVQLNTS; DNWRSELYKYKVVKI; WRSELYKYK; DRDRSIRLVNGSL AL; IRLVNGSLA; DREINNYTSLIHSLI; INNYTSLIH; DRSIRLVNGSLAL IW; IRLVNGSLA; DRSIRLVNGSLALIW; LVNGSLALI; DRVIEVVQGAC RAIR; VVQGACRAI; DTEVHNVWATHACVP; VHNVWATHA; DTTSYK LTSCNTSVI; SYKLTSCNT; DTTSYKLTSCNTSVI; YKLTSCNTS; EALK YWWNLLQYWSQ; LKYWWNLLQ; EALKYWWNLLQYWSQ; WWNLL QYWS; EALKYWWNLLQYWSQ; YWWNLLQYW; EAQQHLLQLTVW GIK; LLQLTVWGI; EATTTLFCASDAKAY; LFCASDAKA; EDIISLWDQ SLKPCV; LWDQSLKPC; EEEVVIRSVNFTDNA; VVIRSVNFT; EEVVIR SVNFTDNAK; VVIRSVNFT; EFFYCNSTQLFNSTW; FYCNSTQLF; EI KNCSFNIS; IKNCSFNIS; EIKNCSFNISTSIRG; SFNISTSIR; EI NCTRPNNNTRKRI; RPNNNTRKR; EINCTRPNNNTRKRI; TRPNNNT RK; EINNYTSLIHSLIEE; YTSLIHSLI; EKGEIKNCSFNISTS; IKNCSFNI S; EKRAVGIGALFLGFL; VGIGALFLG; EKYQHLWRWGWRWGT; LW RWGWRWG; EKYQHLWRWGWRWGT; QHLWRWGWR; EKYQHLW RWGWRWGT; YQHLWRWGW; ELDKWASLWNWFNIT; WASLWNW FN; ELKNSAVSLLNATAI; LKNSAVSLL; ELLELDKWASLWNWF; LDK WASLWN; ELYKYKVVKIEPLGV; YKVVKIEPL; ELYKYKVVKIEPLGV; YKYKVVKIE; ENFNMWKNDMVEQMH; FNMWKNDMV; ENFNMWKN DMVEQMH; WKNDMVEQM; EPIPIHYCAPAGFAI; HYCAPAGFA; EPL GVAPTKAKRRVV; VAPTKAKRR; EQELLELDKWASLWN; LLELDKW AS; EQFGNNKTIIFKQSS; FGNNKTIIF; EQIWNHTTWMEWDRE; IWN HTTWME; EVHNVWATHACVPTD; WATHACVPT; EVVIRSVNFTDNA KT; VVIRSVNFT; EVVLVNVTENFNMWK; LVNVTENFN; EVVQGACR AIRHIPR; VVQGACRAI; EWDREINNYTSLIHS; INNYTSLIH; EYAFFY KLDIIPIDN; YKLDIIPID; FAVLSIVNRVRQGYS; LSIVNRVRQ; FAVLSI VNRVRQGYS; VLSIVNRVR; FFYKLDIIPIDNDTT; YKLDIIPID; FGNNK TIIFKQSSGG; FGNNKTIIF; FIMIVGGLVGLRIVF; IMIVGGLVG; FIMIV GGLVGLRIVF; IVGGLVGLR; FIMIVGGLVGLRIVF; VGGLVGLRI; FLG FLGAAGSTMGAA; FLGAAGSTM; FLGFLGAAGSTMGAA; LGAAGST MG; FLGAAGSTMGAASMT; LGAAGSTMG; FNGTGPCTNVSTVQC; F NGTGPCTN; FNISTSIRGKVQKEY; FNISTSIRG; FNITNWLWYIKLFI M; FNITNWLWY; FNITNWLWYIKLFIM; ITNWLWYIK; FNMWKNDMVE QMHED; FNMWKNDMV; FNMWKNDMVEQMHED; WKNDMVEQM; F NSTWFNSTWSTEGS; FNSTWSTEG; FNSTWFNSTWSTEGS; WFN STWSTE; FNSTWSTEGSNNTEG; FNSTWSTEG; FNSTWSTEGSNN TEG; WSTEGSNNT; FQTHLPTPRGPDRPE; FQTHLPTPR; FSYHRLR DLLLIVTR; LRDLLLIVT; FVTIGKIGNMRQAHC; IGKIGNMRQ; GACRA IRHIPRRIRQ; IRHIPRRIR; GALFLGFLGAAGSTM; FLGFLGAAG; GAL FLGFLGAAGSTM; LGFLGAAGS; GCSGKLICTTAVPWN; GKLICTTA V; GCSGKLICTTAVPWN; LICTTAVPW; GDMRDNWRSELYKYK; RD NWRSELY; GEFFYCNSTQLFNST; FYCNSTQLF; GEIKNCSFNISTSI R; IKNCSFNIS; GFAILKCNNKTFNGT; LKCNNKTFN; GFLGAAGSTM GAASM; LGAAGSTMG; GGEFFYCNSTQLFNS; FYCNSTQLF; GGLV GLRIVFAVLSI; LRIVFAVLS; GGLVGLRIVFAVLSI; VGLRIVFAV; GIGA LFLGFLGAAGS; FLGFLGAAG; GIKQLQARILAVERY; IKQLQARIL; GI RPVVSTQLLLNGS; IRPVVSTQL; GIVQQQNNLLRAIEA; VQQQNNLL R; GKAMYAPPISGQIRC; YAPPISGQI; GKLICTTAVPWNASW; ICTTA VPWN; GKLICTTAVPWNASW; LICTTAVPW; GLRIVFAVLSIVNRV; F AVLSIVNR; GLRIVFAVLSIVNRV; LRIVFAVLS; GLVGLRIVFAVLSIV; L RIVFAVLS; GLVGLRIVFAVLSIV; VGLRIVFAV; GMLMICSATEKLWV T; MICSATEKL; GRAFVTIGKIGNMRQ; FVTIGKIGN; GSLALIWDDLR SLCL; LIWDDLRSL; GSTMGAASMTLTVQA; MGAASMTLT; GTMLLG MLMICSATE; LLGMLMICS; GVAPTKAKRRVVQRE; PTKAKRRVV; G VAPTKAKRRVVQRE; VAPTKAKRR; GVPVWKEATTTLFCA; WKEAT TTLF; GWEALKYWWNLLQYW; LKYWWNLLQ; GWRWGTMLLGMLM IC; WGTMLLGML; GWRWGTMLLGMLMIC; WRWGTMLLG; GYSPLS FQTHLPTPR; LSFQTHLPT; GYSPLSFQTHLPTPR; YSPLSFQTH; GA AGSTMGAASMTLT; STMGAASMT; GAAGSTMGAASMTLT; TMGAA SMTL; GAASMTLTVQARQLL; TLTVQARQL; HACVPTDPNPQEVVL; VPTDPNPQE; HCNISRAKWNNTLKQ; RAKWNNTLK; HEDIISLWDQ SLKPC; IISLWDQSL; HEDIISLWDQSLKPC; ISLWDQSLK; HGIRPVV STQLLLNG; IRPVVSTQL; HLLQLTVWGIKQLQA; LLQLTVWGI; HLW RWGWRWGTMLLG; GWRWGTMLL; HLWRWGWRWGTMLLG; LWR WGWRWG; HLWRWGWRWGTMLLG; WGWRWGTML; HNVWATHA CVPTDPN; WATHACVPT; HRLRDLLLIVTRIVE; HRLRDL LLIVTRIVE; LRDLLLIVT; HTTWMEWDREINNYT; MEWDREINN; IASK LREQFGNNKTI; LREQFGNNK; ICTTAVPWNASWSNK; VPWNASWS N; IEAQQHLLQLTVWGI; AQQHLLQLT; IEPLGVAPTKAKRRV; VAPTK AKRR; IEVVQGACRAIRHIP; VVQGACRAI; IGALFLGFLGAAGST; FL GFLGAAG; IGALFLGFLGAAGST; LGFLGAAGS; IHYCAPAGFAILKC N; YCAPAGFAI; IIFKQSSGGDPEIVT; FKQSSGGDP; IINMWQKVGKA | |

| Protein accession no/ name | Antigenic peptides | SEQ ID NO |
|---|---|---|
| | MYAP; INMWQKVGK; IINMWQKVGKAMYAP; MWQKVGKAM; IINMW QKVGKAMYAP; WQKVGKAMY; IISLWDQSLKPCVKL; LWDQSLKPC; IIVQLNTSVEINCTR; VQLNTSVE; IIVQLNTSVEINCTR; VQLNTSVEI; IKLFIMIVGGLVGLR; FIMIVGGLV; IKLFIMIVGGLVGLR; IKLFIMIVG; I KLFIMIVGGLVGLR; IMIVGGLVG; IKNCSFNISTSIRGK; FNISTSIRG; I KNCSFNISTSIRGK; IKNCSFNIS; IKQIINMWQKVGKAM; IINMWQKV G; IKQIINMWQKVGKAM; INMWQKVGK; IKQLQARILAVERYL; IKQLQ ARIL; IMEKGEIKNCSFNIS; EKGEIKNCS; IMIVGGLVGLRIVFA; IMIVG GLVG; IMIVGGLVGLRIVFA; IVGGLVGLR; IMIVGGLVGLRIVFA; VGG LVGLRI; INCTRPNNNTRKRIR; PNNNTRKRI; INCTRPNNNTRKRIR; T RPNNNTRK; INMWQKVGKAMYAPP; MWQKVGKAM; INMWQKVGK AMYAPP; WQKVGKAMY; INNYTSLIHSLIEES; YTSLIHSLI; IPIHYCAP AGFAILK; YCAPAGFAI; IQRGPGRAFVTIGKI; IQRGPGRAF; IRCSSNI TGLLLTRD; IRCSSNITG; IRIQRGPGRAFVTIG; IQRGPGRAF; IRIQR GPGRAFVTIG; IRIQRGPGR; IRLVNGSLALIWDDL; IRLVNGSLA; IRL VNGSLALIWDDL; LVNGSLALI; IRPVVSTQLLLNGSL; IRPVVSTQL; IS LWDQSLKPCVKLT; LWDQSLKPC; ISRAKWNNTLKQIAS; RAKWNN TLK; ISRAKWNNTLKQIAS; WNNTLKQIA; ITGLLLTRDGGNSNN; ITG LLLTRD; ITNWLWYIKLFIMIV; ITNWLWYIK; ITNWLWYIKLFIMIV; LW YIKLFIM; ITNWLWYIKLFIMIV; WYIKLFIMI; ITQACPKVSFEPIPI; ITQA CPKVS; IVELLGRRGWEALKY; IVELLGRRG; IVELLGRRGWEALKY; LLGRRGWEA; IVFAVLSIVNRVRQG; FAVLSIVNR; IVFAVLSIVNRVR QG; LSIVNRVRQ; IVFAVLSIVNRVRQG; VLSIVNRVR; IVGGLVGLRIV FAVL; LVGLRIVFA; IVGGLVGLRIVFAVL; VGLRIVFAV; IVNRVRQGY SPLSFQ; VRQGYSPLS; IVQLNTSVEINCTRP; VQLNTSVEI; IVQQQN NLLRAIEAQ; IVQQQNNLL; IVQQQNNLLRAIEAQ; VQQQNNLLR; IVT RIVELLGRRGWE; IVELLGRRG; IVTRIVELLGRRGWE; TRIVELLGR; I WDDLRSLCLFSYHR; LRSLCLFSY; IWNHTTWMEWDREIN; IWNHTT WME; KAMYAPPISGQIRCS; YAPPISGQI; KAYDTEVHNVWATHA; TE VHNVWAT; KCNNKTFNGTGPCTN; TFNGTGPCT; KCTDLKNDTNTN SSS; LKNDTNTNS; KEKYQHLWRWGWRWG; QHLWRWGWR; KEKY QHLWRWGWRWG; YQHLWRWGW; KEYAFFYKLDIIPID; FYKLDIIPI; KEYAFFYKLDIIPID; YAFFYKLDI; KGEIKNCSFNISTSI; IKNCSFNIS; KIEPLGVAPTKAKRR; LGVAPTKAK; KLFIMIVGGLVGLRI; IMIVGGLV G; KLFIMIVGGLVGLRI; IVGGLVGLR; KLICTTAVPWNASWS; ICTTAV PWN; KLICTTAVPWNASWS; LICTTAVPW; KLREQFGNNKTIIFK; FG NNKTIIF; KLTSCNTSVITQACP; LTSCNTSVI; KLWVTVYYGVPVWKE; VTVYYGVPV; KNCSFNISTSIRGKV; FNISTSIRG; KNSAVSLLNATAI AV; VSLLNATAI; KPCVKLTPLCVSLKC; LTPLCVSLK; KQIINMWQKV GKAMY; INMWQKVGK; KQIINMWQKVGKAMY; MWQKVGKAM; KRA VGIGALFLGFLG; VGIGALFLG; KRIRIQRGPGRAFVT; IQRGPGRAF; KRIRIQRGPGRAFVT; IRIQRGPGR; KSLEQIWNHTTWMEW; IWNHT TWME; KTFNGTGPCTNVSTV; FNGTGPCTN; KTIIFKQSSGGDPEI; F KQSSGGDP; KTIIVQLNTSVEINC; IVQLNTSVE; KTIIVQLNTSVEINC; VQLNTSVEI; KVGKAMYAPPISGQI; GKAMYAPPI; KVVKIEPLGVAPT KA; IEPLGVAPT; KWASLWNWFNITNWL; WASLWNWFN; KWNNTLK QIASKLRE; LKQIASKLR; KYKVVKIEPLGVAPT; VKIEPLGVA; KYKVV KIEPLGVAPT; VVKIEPLGV; KYQHLWRWGWRWGTM; LWRWGWR WG; KYQHLWRWGWRWGTM; QHLWRWGWR; KYWWNLLQYWSQ ELK; KYWWNLLQY; KYWWNLLQYWSQELK; WNLLQYWSQ; KYWW NLLQYWSQELK; YWWNLLQYW; LAEEEVVIRSVNFTD; VVIRSVNFT; LALIWDDLRSLCLFS; WDDLRSLCL; LCLFSYHRLRDLLLI; YHRLRD LLL; LDKWASLWNWFNITN; WASLWNWFN; LELDKWASLWNWFNI; WASLWNWFN; LEQIWNHTTWMEWDR; IWNHTTWME; LEQIWNHT TWMEWDR; WNHTTWMEW; LFIMIVGGLVGLRIV; IMIVGGLVG; LFI MIVGGLVGLRIV; VGGLVGLRI; LFLGFLGAAGSTMGA; FLGFLGAAG; LFLGFLGAAGSTMGA; FLGAAGSTM; LFLGFLGAAGSTMGA; LGAA GSTMG; LFNSTWFNSTWSTEG; FNSTWFNST; LFNSTWFNSTWST EG; LFNSTWFNS; LFNSTWFNSTWSTEG; STWFNSTWS; LFNSTWF NSTWSTEG; TWFNSTWST; LFNSTWFNSTWSTEG; WFNSTWSTE; LFSYHRLRDLLLIVT; YHRLRDLLL; LGFLGAAGSTMGAAS; LGAAGS TMG; LGMLMICSATEKLWV; MLMICSATE; LGVAPTKAKRRVVQR; P TKAKRRVV; LGVAPTKAKRRVVQR; VAPTKAKRR; LGAAGSTMGAA SMTL; LGAAGSTMG; LICTTAVPWNASWSN; LICTTAVPW; LICTTAV PWNASWSN; TTAVPWNAS; LIVTRIVELLGRRGW; IVELLGRRG; LIV TRIVELLGRRGW; TRIVELLGR; LIWDDLRSLCLFSYH; WDDLRSLCL; LKCTDLKNDTNTNSS; LKNDTNTNS; LKNSAVSLLNATAIA; LKNSAV SLL; LKPCVKLTPLCVSLK; CVKLTPLCV; LKQIASKLREQFGNN; LKQ IASKLR; LKYWWNLLQYWSQEL; LKYWWNLLQ; LKYWWNLLQYWS QEL; YWWNLLQYW; LLELDKWASLWNWFN; LDKWASLWN; LLGML MICSATEKLW; LLGMLMICS; LLIVTRIVELLGRRG; IVTRIVELL; LLIVT RIVELLGRRG; LLIVTRIVE; LLIVTRIVELLGRRG; TRIVELLGR; LLLIV TRIVELLGRR; IVTRIVELL; LLLIVTRIVELLGRR; LIVTRIVEL; LLLIVTR IVELLGRR; LLIVTRIVE; LLLIVTRIVELLGRR; TRIVELLGR; LLNATAIA VAEGTDR; LLNATAIAV; LLQLTVWGIKQLQAR; LLQLTVWGI; LLQY | |

| Protein accession no/ name | Antigenic peptides | SEQ ID NO |
|---|---|---|
| | WSQELKNSAVS; WSQELKNSA; LLQYWSQELKNSAVS; YWSQELK NS; LLRAIEAQQHLLQLT; LRAIEAQQH; LLSGIVQQQNNLLRA; IVQQ QNNLL; LLSGIVQQQNNLLRA; VQQQNNLLR; LNATAIAVAEGTDRV; LNATAIAVA; LQLTVWGIKQLQARI; WGIKQLQAR; LQYWSQELKNS AVSL; YWSQELKNS; LRAIEAQQHLLQLTV; LRAIEAQQH; LRDLLLIV TRIVELL; LIVTRIVEL; LRDLLLIVTRIVELL; LLIVTRIVE; LRDLLLIVTRI VELL; LRDLLLIVT; LREQFGNNKTIIFKQ; FGNNKTIIF; LRIVFAVLSIV NRVR; FAVLSIVNR; LRIVFAVLSIVNRVR; LRIVFAVLS; LRIVFAVLSIV NRVR; VFAVLSIVN; LRSLCLFSYHRLRDL; LRSLCLFSY; LSFQTHLP TPRGPDR; FQTHLPTPR; LSFQTHLPTPRGPDR; QTHLPTPRG; LSGI VQQQNNLLRAI; IVQQQNNLL; LSGIVQQQNNLLRAI; VQQQNNLLR; LSIVNRVRQGYSPLS; IVNRVRQGY; LSIVNRVRQGYSPLS; RVRQG YSPL; LSIVNRVRQGYSPLS; VNRVRQGYS; LTSCNTSVITQACPK; L TSCNTSVI; LTVQARQLLSGIVQQ; LTVQARQLL; LTVQARQLLSGIV QQ; VQARQLLSG; LTVWGIKQLQARILA; IKQLQARIL; LTVWGIKQLQ ARILA; WGIKQLQAR; LVGLRIVFAVLSIVN; LRIVFAVLS; LVNGSLALI WDDLRS; LVNGSLALI; LWNWFNITNWLWYIK; FNITNWLWY; LWNW FNITNWLWYIK; WFNITNWLW; LWRWGWRWGTMLLGM; GWRWG TMLL; LWRWGWRWGTMLLGM; LWRWGWRWG; LWRWGWRWGT MLLGM; WRWGTMLLG; LWVTVYYGVPVWKEA; YYGVPVWKE; LW YIKLFIMIVGGLV; IKLFIMIVG; LWYIKLFIMIVGGLV; YIKLFIMIV; LYKY KVVKIEPLGVA; VVKIEPLGV; LYKYKVVKIEPLGVA; YKVKIEPL; ME KGEIKNCSFNIST; IKNCSFNIS; MEWDREINNYTSLIH; EINNYTSLI; M EWDREINNYTSLIH; MEWDREINN; MGAASMTLTVQARQL; MGAAS MTLT; MHEDIISLWDQSLKP; ISLWDQSLK; MIVGGLVGLRIVFAV; IV GGLVGLR; MIVGGLVGLRIVFAV; LVGLRIVFA; MIVGGLVGLRIVFAV; VGGLVGLRI; MLLGMLMICSATEKL; LLGMLMICS; MRDNWRSELYK YKVV; WRSELYKYK; MRVKEKYQHLWRWGW; MRVKEKYQH; MTLT VQARQLLSGIV; LTVQARQLL; MTLTVQARQLLSGIV; VQARQLLSG; MWQKVGKAMYAPPIS; QKVGKAMYA; NAKTIIVQLNTSVEI; IIVQLNT SV; NAKTIIVQLNTSVEI; IVQLNTSVE; NATAIAVAEGTDRVI; TAIAVA EGT; NCSFNISTSIRGKVQ; FNISTSIRG; NCTRPNNNTRKRIRI; PNN NTRKRI; NCTRPNNNTRKRIRI; TRPNNNTRK; NFNMWKNDMVEQM HE; FNMWKNDMV; NFNMWKNDMVEQMHE; WKNDMVEQM; NHTT WMEWDREINNY; MEWDREINN; NISRAKWNNTLKQIA; AKWNNTLK Q; NISRAKWNNTLKQIA; RAKWNNTLK; NITGLLLTRDGGNSN; ITGLL LTRD; NITNWLWYIKLFIMI; ITNWLWYIK; NKSLEQIWNHTTWME; LE QIWNHTT; NKTFNGTGPCTNVST; FNGTGPCTN; NKTIIFKQSSGGD PE; FKQSSGGDP; NLLQYWSQELKNSAV; LQYWSQELK; NLLQYWS QELKNSAV; YWSQELKNS; NLLRAIEAQQHLLQL; LRAIEAQQH; NM WQKVGKAMYAPPI; QKVGKAMYA; NMWQKVGKAMYAPPI; WQKV GKAMY; NNKTFNGTGPCTNVS; FNGTGPCTN; NNKTIIFKQSSGGD P; IFKQSSGGD; NNLLRAIEAQQHLLQ; LRAIEAQQH; NNTLKQIASKL REQF; LKQIASKLR; NNTRKRIRIQRGPGR; TRKRIRIQR; NPQEVVLV NVTENFN; VVLVNVTEN; NRVRQGYSPLSFQTH; VRQGYSPLS; NSA VSLLNATAIAVA; LLNATAIAV; NSTQLFNSTWFNSTW; FNSTWFNST; NSTQLFNSTWFNSTW; LFNSTWFNS; NSTWFNSTWSTEGSN; FNS TWSTEG; NSTWFNSTWSTEGSN; WFNSTWSTE; NSTWSTEGSNN TEGS; WSTEGSNNT; NTLKQIASKLREQFG; LKQIASKLR; NTRKRIRI QRGPGRA; IRIQRGPGR; NTSVITQACPKVSFE; ITQACPKVS; NVTE NFNMWKNDMVE; FNMWKNDMV; NVWATHACVPTDPNP; HACVPT DPN; NVWATHACVPTDPNP; WATHACVPT; NWFNITNWLWYIKLF; F NITNWLWY; NWFNITNWLWYIKLF; ITNWLWYIK; NWFNITNWLWYI KLF; WFNITNWLW; NWLWYIKLFIMIVGG; IKLFIMIVG; NWLWYIKLFI MIVGG; LWYIKLFIM; NWLWYIKLFIMIVGG; YIKLFIMIV; NWRSELYK YKVVKIE; WRSELYKYK; PCRIKQIINMWQKVG; IKQIINMWQ; PCVKL TPLCVSLKCT; LTPLCVSLK; PIHYCAPAGFAILKC; YCAPAGFAI; PIPI HYCAPAGFAIL; YCAPAGFAI; PLGVAPTKAKRRVVQ; PTKAKRRVV; PLGVAPTKAKRRVVQ; VAPTKAKRR; PLSFQTHLPTPRGPD; FQTHL PTPR; PLSFQTHLPTPRGPD; QTHLPTPRG; PNPQEVVLVNVTENF; VVLVNVTEN; PQEVVLVNVTENFNM; LVNVTENFN; PVVSTQLLLNG SLAE; VSTQLLLNG; PVWKEATTTLFCASD; WKEATTTLF; PWNASW SNKSLEQIW; WNASWSNKS; QARQLLSGIVQQQNN; LLSGIVQQQ; QCTHGIRPVVSTQLL; IRPVVSTQL; QELKNSAVSLLNATA; LKNSAV SLL; QELLELDKWASLWNW; LDKWASLWN; QEVVLVNVTENFNMW; LVNVTENFN; QFGNNKTIIFKQSSG; FGNNKTIIF; QGACRAIRHIPRR IR; RAIRHIPRR; QHLLQLTVWGIKQLQ; LLQLTVWGI; QHLWRWGW RWGTMLL; LWRWGWRWG; QHLWRWGWRWGTMLL; QHLWRWG WR; QHLWRWGWRWGTMLL; WGWRWGTML; QIASKLREQFGNNK T; LREQFGNNK; QIINMWQKVGKAMYA; INMWQKVGK; QIINMWQK VGKAMYA; MWQKVGKAM; QIINMWQKVGKAMYA; WQKVGKAMY; QIWNHTTWMEWDREI; IWNHTTWME; QKVGKAMYAPPISGQ; GKA MYAPPI; QLFNSTWFNSTWSTE; FNSTWFNST; QLFNSTWFNSTWS TE; LFNSTWFNS; QLFNSTWFNSTWSTE; STWFNSTWS; QLLSGIVQ QQNNLLR; IVQQQNNLL; QLTVWGIKQLQARIL; WGIKQLQAR; QNNL | |

| Protein accession no/ name | Antigenic peptides | SEQ ID NO |
|---|---|---|
| | LRAIEAQQHLL; LRAIEAQQH; QQHLLQLTVWGIKQL; LLQLTVWGI; QQNNLLRAIEAQQHL; LRAIEAQQH; QQQNNLLRAIEAQQH; LLRAIEAQQ; QQQNNLLRAIEAQQH; NNLLRAIEA; QREKRAVGIGALFLG; AVGIGALFL; QREKRAVGIGALFLG; RAVGIGALF; QSLKPCVKLTPLCVS; CVKLTPLCV; QTHLPTPRGPDRPEG; QTHLPTPRG; QYWSQELKNSAVSLL; ELKNSAVSL; QYWSQELKNSAVSLL; WSQELKNSA; RAFVTIGKIGNMRQA; FVTIGKIGN; RAIRHIPRRIRQGLE; IRHIPRRIR; RAKWNNTLKQIASKL; WNNTLKQIA; RAVGIGALFLGFLGA; VGIGALFLG; RCSSNITGLLLTRDG; ITGLLLTRD; RDLLLIVTRIVELLG; LIVTRIVEL; RDLLLIVTRIVELLG; LLIVTRIVE; RDLLLIVTRIVELLG; LLLIVTRIV; RDNWRSELYKYKVVK; WRSELYKYK; RDRDRSIRLVNGSLA; DRSIRLVNG; RDRSIRLVNGSLALI; IRLVNGSLA; REINNYTSLIHSLIE; INNYTSLIH; REINNYTSLIHSLIE; YTSLIHSLI; REKRAVGIGALFLGF; VGIGALFLG; REQFGNNKTIIFKQS; FGNNKTIIF; RGWEALKYWWNLLQY; LKYWWNLLQ; RIKQIINMWQKVGKA; IINMWQKVG; RIKQIINMWQKVGKA; INMWQKVGK; RIQRGPGRAFVTIGK; IQRGPGRAF; RIRIQRGPGRAFVTI; IQRGPGRAF; RIRIQRGPGRAFVTI; IRIQRGPGR; RIVELLGRRGWEALK; IVELLGRRG; RIVFAVLSIVNRVRQ; FAVLSIVNR; RIVFAVLSIVNRVRQ; VLSIVNRVR; RKRIRIQRGPGRAFV; IQRGPGRAF; RKRIRIQRGPGRAFV; IRIQRGPGR; RLRDLLLIVTRIVEL; LLIVTRIVE; RLRDLLLIVTRIVEL; LLLIVTRIV; RLRDLLLIVTRIVEL; LRDLLLIVT; RLVNGSLALIWDDLR; VNGSLALIW; RPVVSTQLLLNGSLA; VVSTQLLLN; RQGYSPLSFQTHLPT; YSPLSFQTH; RQLLSGIVQQQNNLL; LLSGIVQQQ; RQLLSGIVQQQNNLL; LSGIVQQQN; RRGWEALKYWWNLLQ; RRGWEALKY; RRGWEALKYWWNLLQ; WEALKYWWN; RSELYKYKVVKIEPL; LYKYKVVKI; RSELYKYKVVKIEPL; YKYKVVKIE; RSIRLVNGSLALIWD; IRLVNGSLA; RSIRLVNGSLALIWD; LVNGSLALI; RVIEVVQGACRAIRH; VVQGACRAI; RVKEKYQHLWRWGWR; YQHLWRWGW; RVRQGYSPLSFQTHL; VRQGYSPLS; RWGTMLLGMLMICSA; LLGMLMICS; RWGTMLLGMLMICSA; WGTMLLGML; RWGWRWGTMLLGMLM; WGTMLLGML; RWGWRWGTMLLGMLM; WRWGTMLLG; SAVSLLNATAIAVAE; LLNATAIAV; SCNTSVITQACPKVS; VITQACPKV; SELYKYKVVKIEPLG; YKVVKIEPL; SFNISTSIRGKVQKE; FNISTSIRG; SFQTHLPTPRGPDRP; FQTHLPTPR; SFQTHLPTPRGPDRP; QTHLPTPRG; SGIVQQQNNLLRAIE; IVQQQNNLL; SGIVQQQNNLLRAIE; VQQQNNLLR; SGKLICTTAVPWNAS; ICTTAVPWN; SGKLICTTAVPWNAS; LICTTAVPW; SIRLVNGSLALIWDD; IRLVNGSLA; SIRLVNGSLALIWDD; LVNGSLALI; SIVNRVRQGYSPLSF; IVNRVRQGY; SIVNRVRQGYSPLSF; VRQGYSPLS; SKLREQFGNNKTIIF; LREQFGNNK; SKLREQFGNNKTIIF; QFGNNKTII; SLAEEEVVIRSVNFT; EEVVIRSVN; SLAEEEVVIRSVNFT; EVVIRSVNF; SLALIWDDLRSLCLF; WDDLRSLCL; SLCLFSYHRLRDLLL; FSYHRLRDL; SLEQIWNHTTWMEWD; IWNHTTWME; SLEQIWNHTTWMEWD; WNHTTWMEW; SLKCTDLKNDTNTNS; DLKNDTNTN; SLKPCVKLTPLCVSL; VKLTPLCVS; SLLNATAIAVAEGTD; LLNATAIAV; SLWDQSLKPCVKLTP; LWDQSLKPC; SLWNWFNITNWLWYI; FNITNWLWY; SLWNWFNITNWLWYI; WFNITNWLW; SLWNWFNITNWLWYI; WNWFNITNW; SMTLTVQARQLLSGI; LTVQARQLL; SMTLTVQARQLLSGI; VQARQLLSG; SNITGLLLTRDGGNS; ITGLLLTRD; SPLSFQTHLPTPRGP; FQTHLPTPR; SPLSFQTHLPTPRGP; QTHLPTPRG; SQELKNSAVSLLNAT; LKNSAVSLL; SRAKWNNTLKQIASK; WNNTLKQIA; SSNITGLLLTRDGGN; ITGLLLTRD; STMGAASMTLTVQAR; MGAASMTLT; STQLFNSTWFNSTWS; FNSTWFNST; STQLFNSTWFNSTWS; LFNSTWFNS; STQLLLNGSLAEEEV; LLLNGSLAE; STVQCTHGIRPVVST; THGIRPVVS; STWFNSTWSTEGSNN; FNSTWSTEG; STWFNSTWSTEGSNN; WFNSTWSTE; STWSTEGSNNTEGSD; WSTEGSNNT; SVEINCTRPNNNTRK; INCTRPNNN; SVITQACPKVSFEPI; ITQACPKVS; SYHRLRDLLLIVTRI; LRDLLLIVT; SYKLTSCNTSVITQA; LTSCNTSVI; TAIAVAEGTDRVIEV; IAVAEGTDR; TAVPWNASWSNKSLE; VPWNASWSN; TAVPWNASWSNKSLE; WNASWSNKS; TDLKNDTNTNSSSGR; LKNDTNTNS; TDNAKTIIVQLNTSV; AKTIIVQLN; TDRVIEVVQGACRAI; EVVQGACRA; TENFNMWKNDMVEQM; FNMWKNDMV; TENFNMWKNDMVEQM; MWKNDMVEQ; TEVHNVWATHACVPT; VHNVWATHA; TFNGTGPCTNVSTVQ; FNGTGPCTN; THACVPTDPNPQEVV; VPTDPNPQE; THGIRPVVSTQLLLN; IRPVVSTQL; TIIFKQSSGGDPEIV; FKQSSGGDP; TIIVQLNTSVEINCT; IVQLNTSVE; TIIVQLNTSVEINCT; VQLNTSVEI; TLFCASDAKAYDTEV; FCASDAKAY; TLKQIASKLREQFGN; LKQIASKLR; TLTVQARQLLSGIVQ; LTVQARQLL; TLTVQARQLLSGIVQ; VQARQLLSG; TMGAASMTLTVQARQ; MGAASMTLT; TMLLGMLMICSATEK; LLGMLMICS; TNWLWYIKLFIMIVG; LWYIKLFIM; TNWLWYIKLFIMIVG; WLWYIKLFI; TNWLWYIKLFIMIVG; YIKLFIMIV; TQLFNSTWFNSTWST; FNSTWFNST; TQLFNSTWFNSTWST; LFNSTWFNS; TQLFNSTWFNSTWST; STWFNSTWS; TRIVELLGRRGWEAL; IVELLGRRG; TRIVELLGRRGWEAL; TRIVELLGR; TRKRIRIQRGPGRAF; IRIQRGPGR; TRKRIRIQRGPGRAF; RKRIRIQRG; TRPNNNTRKRIRIQR; PNNNTRKRI; | |

| Protein accession no/ name | Antigenic peptides | SEQ ID NO |
|---|---|---|
| | TSVITQACPKVSFEP; ITQACPKVS; TSYKLTSCNTSVITQ; LTSCNT SVI; TTAVPWNASWSNKSL; VPWNASWSN; TTAVPWNASWSNKSL; WNASWSNKS; TTLFCASDAKAYDTE; FCASDAKAY; TTSYKLTSCN TSVIT; LTSCNTSVI; TTSYKLTSCNTSVIT; YKLTSCNTS; TTTLFCAS DAKAYDT; FCASDAKAY; TTWMEWDREINNYTS; MEWDREINN; TV QARQLLSGIVQQQ; VQARQLLSG; TVQCTHGIRPVVSTQ; THGIRPV VS; TVWGIKQLQARILAV; IKQLQARIL; TVWGIKQLQARILAV; WGIKQ LQAR; TVYYGVPVWKEATTT; YYGVPVWKE; TWFNSTWSTEGSNN T; FNSTWSTEG; TWMEWDREINNYTSL; MEWDREINN; VAPTKAKR RVVQREK; PTKAKRRVV; VAPTKAKRRVVQREK; VAPTKAKRR; VEI NCTRPNNNTRKR; TRPNNNTRK; VFAVLSIVNRVRQGY; LSIVNRVR Q; VFAVLSIVNRVRQGY; VFAVLSIVN; VFAVLSIVNRVRQGY; VLSIV NRVR; VGGLVGLRIVFAVLS; LVGLRIVFA; VGGLVGLRIVFAVLS; VG LRIVFAV; VGIGALFLGFLGAAG; IGALFLGFL; VGIGALFLGFLGAAG; LFLGFLGAA; VGKAMYAPPISGQIR; YAPPISGQI; VGLRIVFAVLSIVN R; IVFAVLSIV; VGLRIVFAVLSIVNR; LRIVFAVLS; VHNVWATHACVP TDP; WATHACVPT; VIEVVQGACRAIRHI; VVQGACRAI; VITQACPKV SFEPIP; ITQACPKVS; VKEKYQHLWRWGWRW; QHLWRWGWR; VK IEPLGVAPTKAKR; IEPLGVAPT; VKIEPLGVAPTKAKR; LGVAPTKAK; VKLTPLCVSLKCTDL; LTPLCVSLK; VLSIVNRVRQGYSPL; IVNRVR QGY; VNGSLALIWDDLRSL; VNGSLALIW; VNRVRQGYSPLSFQT; V RQGYSPLS; VNVTENFNMWKNDMV; NFNMWKNDM; VNVTENFNM WKNDMV; TENFNMWKN; VPVWKEATTTLFCAS; WKEATTTLF; VPW NASWSNKSLEQI; WNASWSNKS; VQARQLLSGIVQQQN; VQARQLL SG; VQCTHGIRPVVSTQL; THGIRPVVS; VQLNTSVEINCTRPN; VQL NTSVEI; VQQQNNLLRAIEAQQ; VQQQNNLLR; VQREKRAVGIGALF L; VQREKRAVG; VRQGYSPLSFQTHLP; VRQGYSPLS; VSLLNATAIA VAEGT; LLNATAIAV; VSTQLLLNGSLAEEE; LLLNGSLAE; VSTVQCT HGIRPVVS; VQCTHGIRP; VTENFNMWKNDMVEQ; FNMWKNDMV; VTIGKIGNMRQAHCN; IGNMRQAHC; VTRIVELLGRRGWEA; IVELL GRRG; VTRIVELLGRRGWEA; TRIVELLGR; VTVYYGVPVWKEATT; YYGVPVWKE; VVIRSVNFTDNAKTI; VVIRSVNFT; VVKIEPLGVAPTK AK; IEPLGVAPT; VVKIEPLGVAPTKAK; VKIEPLGVA; VVLVNVTENF NMWKN; LVNVTENFN; VVSTQLLLNGSLAEE; STQLLLNGS; VWATH ACVPTDPNPQ; HACVPTDPN; VWGIKQLQARILAVE; IKQLQARIL; V WGIKQLQARILAVE; WGIKQLQAR; VWKEATTTLFCASDA; WKEATT TLF; VYYGVPVWKEATTTL; PVWKEATTT; VYYGVPVWKEATTTL; Y YGVPVWKE; WASLWNWFNITNWLW; ASLWNWFNI; WASLWNWFN ITNWLW; WASLWNWFN; WATHACVPTDPNPQE; HACVPTDPN; WD DLRSLCLFSYHRL; LRSLCLFSY; WDREINNYTSLIHSL; INNYTSLIH; WEALKYWWNLLQYWS; LKYWWNLLQ; WEALKYWWNLLQYWS; Y WWNLLQYW; WFNITNWLWYIKLFI; FNITNWLWY; WFNITNWLWYIK LFI; ITNWLWYIK; WFNITNWLWYIKLFI; WFNITNWLW; WFNSTWSTE GSNNTE; FNSTWSTEG; WFNSTWSTEGSNNTE; NSTWSTEGS; WF NSTWSTEGSNNTE; WSTEGSNNT; WGCSGKLICTTAVPW; WGCS GKLIC; WGIKQLQARILAVER; IKQLQARIL; WGTMLLGMLMICSAT; L GMLMICSA; WGTMLLGMLMICSAT; LLGMLMICS; WGWRWGTMLL GMLMI; WGTMLLGML; WGWRWGTMLLGMLMI; WRWGTMLLG; WK EATTTLFCASDAK; WKEATTTLF; WLWYIKLFIMIVGGL; IKLFIMIVG; WLWYIKLFIMIVGGL; YIKLFIMIV; WMEWDREINNYTSLI; MEWDREI NN; WNASWSNKSLEQIWN; WNASWSNKS; WNHTTWMEWDREINN; WMEWDREIN; WNLLQYWSQELKNSA; LQYWSQELK; WNLLQYWS QELKNSA; YWSQELKNS; WNNTLKQIASKLREQ; LKQIASKLR; WNW FNITNWLWYIKL; FNITNWLWY; WNWFNITNWLWYIKL; ITNWLWYIK; WNWFNITNWLWYIKL; WFNITNWLW; WQKVGKAMYAPPISG; GKA MYAPPI; WRSELYKYKVVKIEP; WRSELYKYK; WRWGTMLLGMLMI CS; WGTMLLGML; WRWGTMLLGMLMICS; WRWGTMLLG; WRWG WRWGTMLLGML; WGWRWGTML; WRWGWRWGTMLLGML; WRW GTMLLG; WSQELKNSAVSLLNA; LKNSAVSLL; WVTVYYGVPVWKE AT; YYGVPVWKE; WWNLLQYWSQELKNS; LLQYWSQEL; WWNLLQ YWSQELKNS; LQYWSQELK; WYIKLFIMIVGGLVG; FIMIVGGLV; WYI KLFIMIVGGLVG; IKLFIMIVG; YAFFYKLDIIPIDND; YKLDIIPID; YCNS TQLFNSTWFNS; TQLFNSTWF; YDTEVHNVWATHACV; VHNVWAT HA; YGVPVWKEATTTLFC; WKEATTTLF; YHRLRDLLLIV

| Protein accession no/name | Antigenic peptides | SEQ ID NO |
|---|---|---|
| | WKE; AAGSTMGAASMTLTV; MGAASMTLT; AASMTLTVQARQLLS; LTVQARQLL | |
| NP_057857 Nef | 8-mer<br>GKWSKSSV; KWSKSSVI; SVIGWPTV; VIGWPTVR; WPTVRERM; TV RERMRR; RMRRAEPA; AEPAADRV; AASRDLEK; NTAATNAA; ATNA ACAW; TNAACAWL; QEEEEVGF; EEEVGFPV; EEVGFPVT; FPVTPQ VP; PVTPQVPL; VTPQVPLR; VPLRPMTY; PLRPMTYK; RPMTYKAA; PMTYKAAV; TYKAAVDL; AAVDLSHF; AVDLSHFL; LSHFLKEK; FLKE KGGL; RRQDILDL; DILDLWIY; ILDLWIYH; DLWIYHTQ; WIYHTQGY; I YHTQGYF; YFPDWQNY; FPDWQNYT; NYTPGPGV; YTPGPGVR; TP GPGVRY; GPGVRYPL; GVRYPLTF; RYPLTFGW; YPLTFGWC; LTFG WCYK; TFGWCYKL; FGWCYKLV; WCYKLVPV; VPVEPDKI; NTSLLH PV; SLLHPVSL; LLHPVSLH; HPVSLHGM; HGMDDPER; PEREVLEW; REVLEWRF; RFDSRLAF; SRLAFHHV; RLAFHHVA; LAFHHVAR; FHH VAREL; RELHPEYF; ELHPEYFK<br>9-mer<br>WSKSSVIGW; SSVIGWPTV; SVIGWPTVR; PTVRERMRR; TVRERM RRA; RMRRAEPAA; RRAEPAADR; RAEPAADRV; EPAADRVGA; GA ASRDLEK; NTAATNAAC; TAATNAACA; AATNAACAW; ATNAACAWL; NAACAWLEA; AQEEEEVGF; EEEEVGFPV; VGFPVTPQV; FPVTPQ VPL; PVTPQVPLR; TPQVPLRPM; QVPLRPMTY; VPLRPMTYK; PLRP MTYKA; RPMTYKAAV; MTYKAAVDL; KAAVDLSHF; AAVDLSHFL; AV DLSHFLK; DLSHFLKEK; HFLKEKGGL; KEKGGLEGL; GLEGLIHSQ; R QDILDLWI; ILDLWIYHT; LWIYHTQGY; WIYHTQGYF; HTQGYFPDW; GYFPDWQNY; FPDWQNYTP; NYTPGPGVR; YTPGPGVRY; VRYPL TFGW; YPLTFGWCY; PLTFGWCYK; LTFGWCYKL; KLVPVEPDK; EN TSLLHPV; GMDDPEREV; DPEREVLEW; EVLEWRFDS; VLEWRFDS R; LEWRFDSRL; WRFDSRLAF; RFDSRLAFH; DSRLAFHHV; RLAFH HVAR; AFHHVAREL; VARELHPEY; RELHPEYFK<br>10-mer<br>KWSKSSVIGW; KSSVIGWPTV; SSVIGWPTVR; VIGWPTVRER; AEP AADRVGA; EPAADRVGAA; NTAATNAACA; TAATNAACAW; WLEAQ EEEEV; EAQEEEEVGF; EVGFPVTPQV; FPVTPQVPLR; VTPQVPLR PM; PQVPLRPMTY; QVPLRPMTYK; VPLRPMTYKA; PLRPMTYKAA; RPMTYKAAVD; MTYKAAVDLS; KAAVDLSHFL; AAVDLSHFLK; GLE GLIHSQR; IHSQRRQDIL; RRQDILDLWI; RQDILDLWIY; DILDLWIYHT; ILDLWIYHTQ; DLWIYHTQGY; LWIYHTQGYF; FPDWQNYTPG; WQ NYTPGPGV; NYTPGPGVRY; TPGPGVRYPL; GPGVRYPLTF; RYPLT FGWCY; YPLTFGWCYK; PLTFGWCYKL; LTFGWCYKLV; FGWCYKL VPV; KLVPVEPDKI; GENTSLLHPV; NTSLLHPVSL; LLHPVSLHGM; S LHGMDDPER; HGMDDPEREV; GMDDPEREVL; PEREVLEWRF; EV LEWRFDSR; VLEWRFDSRL; EWRFDSRLAF; WRFDSRLAFH; SRLA FHHVAR; LAFHHVAREL; HVARELHPEY<br>11-mer<br>SKSSVIGWPTV; KSSVIGWPTVR; SVIGWPTVRER; WPTVRERMRR A; RMRRAEPAADR; AEPAADRVGAA; EPAADRVGAAS; RVGAASRD LEK; TSSNTAATNAA; NTAATNAACAW; TAATNAACAWL; LEAQEEE EVGF; AQEEEEVGFPV; EEVGFPVTPQV; FPVTPQVPLRP; PVTPQV PLRPM; TPQVPLRPMTY; QVPLRPMTYKA; VPLRPMTYKAA; PLRPM TYKAAV; RPMTYKAAVDL; MTYKAAVDLSH; TYKAAVDLSHF; YKAA VDLSHFL; KAAVDLSHFLK; AVDLSHFLKEK; FLKEKGGLEGL; GLIHS QRRQDI; RRQDILDLWIY; DILDLWIYHTQ; ILDLWIYHTQG; LDLWIYH TQGY; IYHTQGYFPDW; FPDWQNYTPGP; WQNYTPGPGVR; YTPG PGVRYPL; VRYPLTFGWCY; RYPLTFGWCYK; YPLTFGWCYKL; PLT FGWCYKLV; CYKLVPVEPDK; VPVEPDKIEEA; SLLHPVSLHGM; HG MDDPEREVL; GMDDPEREVLE; DPEREVLEWRF; EVLEWRFDSRL; VLEWRFDSRLA; LEWRFDSRLAF; WRFDSRLAFHH; RFDSRLAFHH V; DSRLAFHHVAR; RLAFHHVAREL; HVARELHPEYF; VARELHPEY FK<br>15-mer + 9-mer core<br>ADRVGAASRDLEKHG; RVGAASRDL; AEPAADRVGAASRDL; AADR VGAAS; AITSSNTAATNAACA; ITSSNTAAT; ASRDLEKHGAITSSN; L EKHGAITS; CYKLVPVEPDKIEEA; YKLVPVEPD; DDPEREVLEWRF DSR; PEREVLEWR; DLEKHGAITSSNTAA; LEKHGAITS; DPEREVLE WRFDSRL; VLEWRFDSR; DSRLAFHHVARELHP; FHHVARELH; DW QNYTPGPGVRYPL; YTPGPGVRY; EEVGFPVTPQVPLRP; GFPVTP QVP; EEVGFPVTPQVPLRP; VGFPVTPQV; EKHGAITSSNTAATN; IT SSNTAAT; ENTSLLHPVSLHGMD; LHPVSLHGM; ENTSLLHPVSLHG MD; LLHPVSLHG; EPAADRVGAASRDLE; RVGAASRDL; EREVLEW RFDSRLAF; LEWRFDSRL; EREVLEWRFDSRLAF; VLEWRFDSR; ER MRRAEPAADRVGA; MRRAEPAAD; EVGFPVTPQVPLRPM; VTPQV PLRP; EVLEWRFDSRLAFHH; VLEWRFDSR; EVLEWRFDSRLAFHH; WRFDSRLAF; EWRFDSRLAFHHVAR; WRFDSRLAF; FDSRLAFHH VARELH; FDSRLAFHH; FGWCYKLVPVEPDKI; YKLVPVEPD; FPDW | 9109-9568 |

| Protein accession no/name | Antigenic peptides | SEQ ID NO |
|---|---|---|
| | QNYTPGPGVRY; FPDWQNYTP; FPDWQNYTPGPGVRY; WQNYTP GPG; FPVTPQVLRPMTYK; VTPQVLRP; GAITSSNTAATNAAC; IT SSNTAAT; GENTSLLHPVSLHGM; LLHPVSLHG; GFPVTPQVLRPM TY; VTPQVPLRP; GWCYKLVPVEPDKIE; YKLVPVEPD; GYFPDWQN YTPGPGV; FPDWQNYTP; GYFPDWQNYTPGPGV; WQNYTPGPG; H GAITSSNTAATNAA; ITSSNTAAT; HTQGYFPDWQNYTPG; QGYFPD WQN; HTQGYFPDWQNYTPG; YFPDWQNYT; ITSSNTAATNAACAW; ITSSNTAAT; IYHTQGYFPDWQNYT; GYFPDWQNY; IYHTQGYFPD WQNYT; QGYFPDWQN; KGENTSLLHPVSLHG; NTSLLHPVS; KGEN TSLLHPVSLHG; SLLHPVSLH; KHGAITSSNTAATNA; ITSSNTAAT; K SSVIGWPTVRERMR; VIGWPTVRE; KWSKSSVIGWPTVRE; KSSVI GWPT; KWSKSSVIGWPTVRE; KWSKSSVIG; LAFHHVARELHPEYF; FHHVARELH; LEKHGAITSSNTAAT; GAITSSNTA; LEKHGAITSSNTA AT; HGAITSSNT; LEWRFDSRLAFHHVA; WRFDSRLAF; LHPVSLHG MDDPERE; LHGMDDPER; LHPVSLHGMDDPERE; LHPVSLHGM; LL HPVSLHGMDDPER; LHPVSLHGM; LLHPVSLHGMDDPER; LLHPVS LHG; LRPMTYKAAVDLSHF; MTYKAAVDL; LTFGWCYKLVPVEPD; G WCYKLVPV; MGGKWSKSSVIGWPT; MGGKWSKSS; MTYKAAVDLS HFLKE; MTYKAAVDL; NTSLLHPVSLHGMDD; LHPVSLHGM; NTSLL HPVSLHGMDD; LLHPVSLHG; NYTPGPGVRYPLTFG; YTPGPGVRY; PDWQNYTPGPGVRYP; WQNYTPGPG; PDWQNYTPGPGVRYP; Y TPGPGVRY; PEREVLEWRFDSRLA; VLEWRFDSR; PLRPMTYKAAV DLSH; MTYKAAVDL; PMTYKAAVDLSHFLK; MTYKAAVDL; PQVPLR PMTYKAAVD; LRPMTYKAA; PTVRERMRRAEPAAD; ERMRRAEPA; PVTPQVPLRPMTYKA; VPLRPMTYK; PVTPQVPLRPMTYKA; VTPQ VPLRP; PAADRVGAASRDLEK; RVGAASRDL; QGYFPDWQNYTPG PG; QGYFPDWQN; QGYFPDWQNYTPGPG; YFPDWQNYT; QNYTP GPGVRYPLTF; YTPGPGVRY; QVPLRPMTYKAAVDL; LRPMTYKAA; RDLEKHGAITSSNTA; LEKHGAITS; RERMRRAEPAADRVG; MRRAE PAAD; REVLEWRFDSRLAFH; VLEWRFDSR; REVLEWRFDSRLAFH; WRFDSRLAF; RLAFHHVARELHPEY; FHHVARELH; RPMTYKAAVD LSHFL; MTYKAAVDL; SKSSVIGWPTVRERM; VIGWPTVRE; SLLHPV SLHGMDDPE; LHPVSLHGM; SLLHPVSLHGMDDPE; LLHPVSLHG; S RDLEKHGAITSSNT; LEKHGAITS; SRLAFHHVARELHPE; FHHVARE LH; SSVIGWPTVRERMRR; VIGWPTVRE; SVIGWPTVRERMRRA; VI GWPTVRE; TFGWCYKLVPVEPDK; YKLVPVEPD; TPQVPLRPMTYK AAV; LRPMTYKAA; TPQVPLRPMTYKAAV; VPLRPMTYK; TQGYFPD WQNYTPGP; QGYFPDWQN; TQGYFPDWQNYTPGP; YFPDWQNYT; TSLLHPVSLHGMDDP; LHPVSLHGM; TSLLHPVSLHGMDDP; LLHP VSLHG; TVRERMRRAEPAADR; MRRAEPAAD; VGFPVTPQVPLRP MT; VTPQVPLRP; VIGWPTVRERMRRAE; VIGWPTVRE; VLEWRFD SRLAFHHV; VLEWRFDSR; VLEWRFDSRLAFHHV; WRFDSRLAF; V PLRPMTYKAAVDLS; LRPMTYKAA; VRERMRRAEPAADRV; MRRAE PAAD; VTPQVPLRPMTYKAA; VPLRPMTYK; VTPQVPLRPMTYKAA; VTPQVPLRP; WCYKLVPVEPDKIEE; YKLVPVEPD; WQNYTPGPGV RYPLT; YTPGPGVRY; WRFDSRLAFHHVARE; WRFDSRLAF; WSKS SVIGWPTVRER; VIGWPTVRE; YFPDWQNYTPGPGVR; WQNYTPG PG; YHTQGYFPDWQNYTP; QGYFPDWQN; YHTQGYFPDWQNYTP; YFPDWQNYT; YKLVPVEPDKIEEAN; YKLVPVEPD; YTPGPGVRYP LTFGW; YTPGPGVRY; AADRVGAASRDLEKH; RVGAASRDL; AASR DLEKHGAITSS; LEKHGAITS | |

In another embodiment the antigenic peptide(s) include one or more of the following peptides IVDCLTEMY (SEQ ID NO 9588), VTDFSVIK (SEQ ID NO 9589), GLIQLVEGV (SEQ ID NO 9590), RIAAWMATY (SEQ ID NO 9591), EYRALQLHL (SEQ ID NO 9592) or any variant or fragment thereof such as antigenic peptides comprising the core sequences listed above or variants thereof.

The present invention further relates to one or more antigenic peptides such as the antigenic peptides disclosed in this application, wherein the one or more antigenic peptides have one or more amino acid substitutions such as 1, 2, 3, 4, 5, 6, 7, or 8.

In a preferred embodiment these amino acid substitutions comprise substitution with an "equivalent amino acid residue". An "equivalent amino acid residue" refers to an amino acid residue capable of replacing another amino acid residue in a polypeptide without substantially altering the structure and/or functionality of the polypeptide. Equivalent amino acids thus have similar properties such as bulkiness of the side-chain, side chain polarity (polar or non-polar), hydrophobicity (hydrophobic or hydrophilic), pH (acidic, neutral or basic) and side chain organization of carbon molecules (aromatic/aliphatic). As such, "equivalent amino acid residues" can be regarded as "conservative amino acid substitutions".

The classification of equivalent amino acids refers in one embodiment to the following classes: 1) HRK, 2) DENQ, 3) C, 4) STPAG, 5) MILV and 6) FYW.

Within the meaning of the term "equivalent amino acid substitution" as applied herein, one amino acid may be substituted for another, in one embodiment, within the groups of amino acids indicated herein below:
Amino acids having polar side chains (Asp, Glu, Lys, Arg, His, Asn, Gin, Ser, Thr, Tyr, and Cys,)
Amino acids having non-polar side chains (Gly, Ala, Val, Leu, lie, Phe, Trp, Pro, and Met)

Amino acids having aliphatic side chains (Gly, Ala Val, Leu, lie)
Amino acids having cyclic side chains (Phe, Tyr, Trp, His, Pro)
Amino acids having aromatic side chains (Phe, Tyr, Trp)
Amino acids having acidic side chains (Asp, Glu)
Amino acids having basic side chains (Lys, Arg, His)
Amino acids having amide side chains (Asn, Gin)
Amino acids having hydroxy side chains (Ser, Thr)
Amino acids having sulphor-containing side chains (Cys, Met),
Neutral, weakly hydrophobic amino acids (Pro, Ala, Gly, Ser, Thr)
Hydrophilic, acidic amino acids (Gln, Asn, Glu, Asp), and
Hydrophobic amino acids (Leu, lie, Val)

A Venn diagram is another method for grouping of amino acids according to their properties (Livingstone & Barton, CABIOS, 9, 745-756, 1993). In another preferred embodiment one or more amino acids may be substituted with another within the same Venn diagram group.

The present invention also relates to a group of peptides called nonsense peptides. A nonsense peptide is here to be understood as a peptide that binds the MHC protein efficiently, but that does not support binding of the resultant MHC-peptide complex to the desired TCR. An example nonsense peptide is a peptide with an amino acid sequence different from the linear sequence of any peptide derived from any known protein. When choosing an appropriate nonsense peptide the following points are taken into consideration. The peptide should ideally have appropriate amino acids at relevant positions that can anchor the peptide to the peptide-binding groove of the MHC. The remaining amino acids should ideally be chosen in such a way that possible binding to TCR (through interactions with the peptide or peptide-binding site of MHC) are minimized. The peptide should ideally be soluble in water to make proper folding with MHC alpha chain and β2m possible in aqueous buffer. The length of the peptide should ideally match the type and allele of MHC complex. The final peptide sequence should ideally be taken through a blast search or similar analysis, to ensure that it is not identical with any peptide sequence found in any known naturally occurring proteins. Nonsense peptides may be used as negative control peptides in experiments with MHC-peptide molecules or MHC multimers.

Attachment of Biologically Active Molecules to Multimerisation Domain(s)

Pharmamers comprises various molecules covalently or non-covalently attached to multimerisation domains. Such molecules include: biological active molecules, molecules having adjuvant effects; molecules being immune targets e.g. antigens or other molecules as described elsewhere herein. In the following principles for attachment of biologically active molecules to multimerisation domains are described, but same principles may be applied to attachment of adjuvant molecules, immune target molecules or any other molecules to multimerisation domains.

In brief, attachment can be done by chemical reactions between reactive groups on the biologically active molecule, e.g. amino groups on the protein surface and reactive groups of the multimerisation domain, e.g. vinyl sulfone functionalities on a dextran polymer and/or between reactive groups on the biologically active molecule. Alternatively, attachment is done by non-covalent interaction between part of the multimerisation domain and part of the biological active molecule. In both covalent and non-covalent attachment of the biologically molecule to the multimerisation domain a linker molecule can connect the two. The linker molecule can be covalent or non-covalent attached to both molecules. Biological active molecules can be attached repetitively aiding to recognition by and stimulation of the innate immune system via Toll or other receptors.

The coupling of one or more multimerization domains and biologically active molecules can involve the association of an entity X (attached to or part of the one or more multimerization domain) and an entity Y (attached to or part of biologically active molecule). Thus, the linker that connects the one or more multimerization domain(s) and the biologically active molecule can comprise an XY portion.

The XY linkage can be covalent, in which case X and Y are reactive groups. In this case, X can be a nucleophilic group (such as $-NH_2$, $-OH$, $-SH$, $-NH-NH_2$), and Y an electrophilic group (such as CHO, COOH, CO) that react to form a covalent bond XY; or Y can be a nucleophilic group and X an electrophilic group that react to form a covalent bond XY. Other possibilities exist, e.g. either of the reactive groups can be a radical, capable of reacting with the other reactive group. A number of reactive groups X and Y, and the bonds that are formed upon reaction of X and Y, are shown in the table below.

X and Y can be reactive groups naturally comprised within the multimerization domain(s) and/or the biologically active molecule, or they can be artificially added reactive groups. Thus, linkers comprising reactive groups can be linked to either of the multimerization domain(s) and the biologically active molecule; subsequently the introduced reactive group(s) can be used to covalently link the one or more multimerization domain(s) and the biologically active molecule.

Example natural reactive groups of biologically active molecules include amino acid side chains comprising $-NH_2$, $-OH$, $-SH$, and $-NH-$. Example natural reactive groups of multimerization domains include hydroxyls of polysaccharides such as dextrans, but also include amino acid side chains comprising $-NH_2$, $-OH$, $-SH$, and $-NH-$ of polypeptides, when the polypeptide is used as one or more multimerization domain(s). In some pharmamers, one of the biologically active is linked by a protein fusion to the one or more multimerization domain(s). Thus, during the translation of the fusion protein, an acyl group (reactive group X or Y) and an amino group (reactive group Y or X) react to form an amide bond. Example is where the biologically active polypeptide chains are fused to one alpha-helic of a coiled-coil structure and where the other alpha helic of a coiled-coil structure is attached to the multimerisation domain. Biologically active proteins are then attached to the multimerisation domain through interaction of the two alpha-helices. Example coiled-coil structure include leucine zipper, fos-jun or other coiled coil structures as described elsewhere herein. Example non-native reactive groups include reactive groups that are attached to the one or more multimerization domain(s) or biologically active protein, through association of a linker molecule comprising the reactive group. The activation of dextran by reaction of the dextran hydroxyls with divinyl sulfone, introduces a reactive vinyl group that can react with e.g. amines of biologically active proteins, to form an amine that now links the one or more multimerization domain(s) (the dextran polymer) and the biologically active protein. Reactive vinyl groups may also react with thiols of the biologically active protein. An alternative activation of the dextran multimerization domain(s) involves a multistep reaction that results in the decoration of the dextran with maleimide groups, as described in the patent Siiman et al.

U.S. Pat. No. 6,387,622. In this approach, the amino groups of biologically active proteins are converted to —SH groups, capable of reacting with the maleimide groups of the activated dextran. Alternatively —SH groups of natural occurring Cysteine or artificial incorporated Cysteine can react with the maleimide. Thus, in the latter examples, both the reactive group of the multimerization domain(s) (the maleimide) and the reactive group of the biologically active protein (the thiol) are artificially introduced.

Sometimes activating reagents are used in order to make the reactive groups more reactive. For example, acids such as glutamate or aspartate can be converted to activated esters by addition of e.g. carbodiimid and NHS or nitrophenol, or by converting the acid moiety to a tosyl-activated ester. The activated ester reacts efficiently with a nucleophile such as —$NH_2$, —SH, —OH, etc.

For the purpose of this invention, the multimerization domain(s) (including small organic scaffold molecules, proteins, protein complexes, polymers, beads, liposomes, micelles, cells) that form a covalent bond with the biologically active proteins can be divided into separate groups, depending on the nature of the reactive group that the one or more multimerization domain(s) contains. One group comprise multimerization domain(s) that carry nucleophilic groups (e.g. —$NH_2$, —OH, —SH, —CN, —NH—$NH_2$), exemplified by polysaccharides, polypeptides comprising e.g. lysine, serine, and cysteine; another group of multimerization domain(s) carry electrophilic groups (e.g. —COOH, —CHO, —CO, NHS-ester, tosyl-activated ester, and other activated esters, acid-anhydrides), exemplified by polypeptides comprising e.g. glutamate and aspartate, or vinyl sulfone activated dextran; yet another group of multimerization domains carry radicals or conjugated double bonds.

The one or more multimerization domain(s) appropriate for this invention can be those that comprise any of the reactive groups shown in FIG. 10 or that can react with other reactive groups to form the bonds shown in the table herein below.

The biologically active proteins can be divided in a similar way, according to the nature of their reactive groups.

In another preferred embodiment the linker can be selected from, but is not limited to, the group consisting of a disulfide-bridge connecting amino acids, heparin or heparan sulfate-derived oligosaccharides (glycosoaminoglycans), bifunctional or chemical cross-linkers, peptide linker, polypeptide linker, flexible linker, synthetic linker, hydrazones, thioethers, esters, disulfides and peptide-containing linkers.

Examples of linkers include but are not limited to a disulfide-bridge connecting amino acids from both polypeptides; heparin or heparan sulfate-derived oligosaccharides (glycosoaminoglycans) connecting both polypeptides; bifunctional or chemical cross-linkers; and a peptide or polypeptide linker. The unimolecular protein can also be a chimera or fusion polypeptide.

The peptide linker sequence is typically flexibly disposed in the fusion protein so as to position the V-alpha and V-beta chains in a configuration which optimally binds an antigen. The peptide linker preferably predominantly comprises amino acids with small side chains, such as glycine, alanine and serine, to provide flexibility. Preferably, about 80 or 90 percent or greater of the linker sequence comprises glycine, alanine or serine residues, particularly glycine and serine residues. Preferably, the linker sequence does not contain any proline residues, which could inhibit flexibility. The linker sequence is suitably attached to the C-terminus of the V-alpha chain and the N-terminus of the V-beta chain of a fusion protein.

Crosslinkers can be either homobifunctional or heterobifunctional. Homobifunctional crosslinkers have two identical reactive groups and often are used in one-step reaction procedures to crosslink proteins to each other or to stabilize quaternary structure. Heterobifunctional crosslinkers possess two different reactive groups that allow for sequential (two-stage) conjugations, helping to minimize undesirable polymerization or self-conjugation. Crosslinkers that are amine-reactive at one end and sulfhydryl-reactive at the other end are especially useful in this regard.

The most widely-used heterobifunctional crosslinkers are those having an amine-reactive succinimidyl ester (i.e., NHS-ester) at one end and a sulfhydrylreactive group on the other end. The sulfhydryl-reactive groups are usually maleimides, pyridyl disulfides and haloacetyls. The NHS-ester reactivity is less stable in aqueous solution and is usually reacted first in sequential crosslinking procedures. NHS-esters react with amines to form amide bonds. Carbodiimides are zero-length crosslinkers and effect direct coupling between carboxylates (—COOH) and primary amines (—$NH_2$).

Other heterobifunctional reagents have one reactive group that is photoreactive rather than thermoreactive. This reactivity allows for specific attachment of the labile thermoreactive group first; subsequently, conjugation to any adjacent N—H or C—H sites can be initiated through the photoreactive group by activation with UV light. Crosslinkers preferably comprise at least two reactive groups. Functional groups that can be targeted for crosslinking include primary amines, sulfhydryls, carbonyls, carbohydrates and carboxylic acids (cf. the Table herein below). Coupling also can be nonselective using a photoreactive phenyl azide crosslinker.

Reactive Crosslinker Groups and their Functional Group Targets

| Reactive Group | Functional Group |
| --- | --- |
| Aryl Azide | Non-selective (or primary amine) |
| Carbodiimide | Amine/Carboxyl |
| Hydrazide | Carbohydrate (oxidized) |
| Hydroxymethyl Phosphine | Amine |
| Imidoester | Amine |
| Isocyanate | Hydroxyl (non-aqueous) |
| Maleimide | Sulfhydryl |
| NHS-ester | Amine |
| PFP-ester | Amine |
| Psoralen | Thymine (photoreactive intercalator) |
| Pyridyl Disulfide | Sulfhydryl |
| Vinyl Sulfone | Sulfhydryl, amine, hydroxyl |

The linker that connects the one or more multimerization domain(s) and the biologically active protein can comprise an XY portion. Above different kinds of covalent linkages XY were described. However, the XY linkage can also be non-covalent.

Non-covalent XY linkages can comprise natural dimerization pairs such as antigen-antibody pairs, DNA-DNA interactions, or can include natural interactions, for example between biotin and streptavidin. Likewise, the interaction of biologically active proteins, including their transmembrane portion with the cell membrane of for example dendritic cells, is an example of a non-covalent XY interaction.

Artificial XY examples include XY pairs such as His$_6$ tag (X) interacting with Ni-NTA (Y) and PNA-PNA, Examples of dimerization- and multimerization domains, appropriate for use as XY non-covalent linkers between the multimerization domain(s) and the biologically active protein, can be found elsewhere in this application.

The abovementioned dimerization- and multimerization domains represent specific binding interactions. Another type of non-covalent interactions involves the non-specific adsorption of e.g. proteins onto surfaces. As an example, the non-covalent adsorption of proteins onto glass beads represents this class of XY interactions.

A preferred embodiment involving non-covalent interactions between X and Y are represented by the pentamer structure described in US patent 2004209295.

Another preferred embodiment involves the use of antibodies, with affinity for a non-biofunctional part of a biologically active protein. Thus, an anti-biomolecule antibody, with its two binding site, will bind two biologically active proteins and in this way generate a bivalent pharmamer. In addition, the antibody in certain instances can stabilize the pharmamer structure through the binding interactions.

The antibodies mentioned above can be selected from, but is not limited to, the group consisting of polyclonal antibody, monoclonal antibody, IgA, IgG, IgM, IgD, IgE, IgG1, IgG2, IgG3, IgG4, IgA1, IgA2, IgM1, IgM2, humanized antibody, humanized monoclonal antibody, Chimeric antibody, mouse antibody, rat antibody, rabbit antibody, human antibody, camel antibody, sheep antibody, engineered human antibody, epitope-focused antibody, agonist antibody, antagonist antibody, neutralizing antibody, naturally-occurring antibody, isolated antibody, monovalent antibody, bispecific antibody, trispecific antibody, multispecific antibody, Heteroconjugate antibody, immunoconjugates, immunoliposomes, labeled antibody, antibody fragment, domain antibody, nanobody, minibody, maxibody, diabody, fusion antibody.

Another preferred embodiment involves use of Streptavidin or Avidin binding biotin on biotinylated biologically active proteins. Said proteins can be biotinylated enzymatically e.g. using a biotinylation tag recognised by BirA enzyme or they can be chemically biotinylated e.g. using Sulfo-NHS esters of biotin reacting with amino groups or maleimide activated biotin reacting with —SH groups.

The Streptavdin or avidin may further be conjugated to a polymer e.g. dextran as described by Winther et al. in patent WO 02/072631.

Also included in the present invention is genetically or chemically modified Streptavidin/Avidin binding natural biotin and/or chemically or genetically modified biotin; and chemically or genetically modified biotin binding natural Streptavidin/Avidin or chemically or genetically Streptavidin/Avidin.

In the present invention another preferred embodiment involving non-covalent interactions between X and Y are use of dimer coiled-coil structures, where one half the coiled structure are attached to the biologically active protein, e.g. as a fusion protein and the other half is attached to the multimerization domain. Example coiled-coil structures include but are not limited to leucine zippers like Fos-Jun, GCN4 leucine zipper, Fos-Jun like leucine zippers, heterodimeric coiled coil structures consisting of a basic peptide and an acidic peptide, heterodimeric coiled coil structures consisting of a basic peptide and an acidic peptide where Cystein are added to the C-termini of the acid and base peptides either directly or through a linker e.g. Gly-Gly, other heterodimeric coiled-coil structures or homodimeric structures.

Generation of Pharmamers

Different approaches to the generation of various types of pharmamers can be applied. In brief, pharmamers can be generated by using molecules purified from natural sources, chemically synthesized or produced by recombinant DNA technology. Use of the latter technology allows for modifications of the natural protein/peptide, most commonly used is fragments that retain special interesting structures or biological function. It involves, first cloning of the genes of interest or modified versions hereof, then expression in a suitable host expression system, and purification of the individual protein components representing antigens, biologically or immunological active proteins, and then combining these components in appropriate numbers and ratios by linking them by covalent or non-covalent bonds to a multimerization domain Size of Pharmamers In one preferred embodiment the pharmamer is between 50,000 Da and 5,000,000 Da, such as from 50,000 Da to 4,000,000 Da; such as from 50,000 Da to 3,000,000 Da; such as from 50,000 Da to 2,000,000; such as from 50,000 Da and 1,000,000 Da, such as from 50,000 Da to 980,000; for example from 50,000 Da to 960,000; such as from 50,000 Da to 940,000; for example from 50,000 Da to 920,000; such as from 50,000 Da to 900,000; for example from 50,000 Da to 880,000; such as from 50,000 Da to 860,000; for example from 50,000 Da to 840,000; such as from 50,000 Da to 820,000; for example from 50,000 Da to 800,000; such as from 50,000 Da to 780,000; for example from 50,000 Da to 760,000; such as from 50,000 Da to 740,000; for example from 50,000 Da to 720,000; such as from 50,000 Da to 700,000; for example from 50,000 Da to 680,000; such as from 50,000 Da to 660,000; for example from 50,000 Da to 640,000; such as from 50,000 Da to 620,000; for example from 50,000 Da to 600,000; such as from 50,000 Da to 580,000; for example from 50,000 Da to 560,000; such as from 50,000 Da to 540,000; for example from 50,000 Da to 520,000; such as from 50,000 Da to 500,000; for example from 50,000 Da to 480,000; such as from 50,000 Da to 460,000; for example from 50,000 Da to 440,000; such as from 50,000 Da to 420,000; for example from 50,000 Da to 400,000; such as from 50,000 Da to 380,000; for example from 50,000 Da to 360,000; such as from 50,000 Da to 340,000; for example from 50,000 Da to 320,000; such as from 50,000 Da to 300,000; for example from 50,000 Da to 280,000; such as from 50,000 Da to 260,000; for example from 50,000 Da to 240,000; such as from 50,000 Da to 220,000; for example from 50,000 Da to 200,000; such as from 50,000 Da to 180,000; for example from 50,000 Da to 160,000; such as from 50,000 Da to 140,000; for example from 50,000 Da to 120,000; such as from 50,000 Da to 100,000; for example from 50,000 Da to 80,000; such as from 50,000 Da to 60,000; such as from 100,000 Da to 980,000; for example from 100,000 Da to 960,000; such as from 100,000 Da to 940,000; for example from 100,000 Da to 920,000; such as from 100,000 Da to 900,000; for example from 100,000 Da to 880,000; such as from 100,000 Da to 860,000; for example from 100,000 Da to 840,000; such as from 100,000 Da to 820,000; for example from 100,000 Da to 800,000; such as from 100,000 Da to 780,000; for example from 100,000 Da to 760,000; such as from 100,000 Da to 740,000; for example from 100,000 Da to 720,000; such as from 100,000 Da to 700,000; for example from 100,000 Da to 680,000; such as from 100,000 Da to 660,000; for example from 100,000 Da to 640,000; such as from 100,000 Da to 620,000; for example from 100,000 Da to 600,000; such as from 100,000 Da to 580,000; for example from 100,000 Da to 560,000; such as from 100,000 Da to 540,000; for example from 100,000 Da to 520,000; such as from 100,000 Da to 500,000; for example from 100,000 Da to 480,000; such as from 100,000 Da to 460,000; for example from 100,000 Da to 440,000; such as from 100,000 Da to 420,000; for example from 100,000 Da to 400,000; such as from 100,000 Da to 380,000; for example from 100,000 Da to 360,000; such as from 100,000 Da to 340,000; for example from 100,000 Da to 320,000; such as from 100,000 Da to 300,000; for example from 100,000 Da to 280,000; such as from 100,000 Da to 260,000; for example from 100,000 Da to 240,000; such as from 100,000 Da to 220,000; for example from 100,000 Da to 200,000; such as from 100,000 Da to 180,000; for example from 100,000 Da to 160,000; such as from 100,000 Da to 140,000; for example from 100,000 Da to 120,000; such as from 150,000 Da to 980,000; for example from 150,000 Da to 960,000; such as from 150,000 Da to 940,000; for example from 150,000 Da to 920,000; such as from 150,000 Da to 900,000; for example from 150,000 Da to 880,000; such as from 150,000 Da to 860,000; for example from 150,000 Da to 840,000; such as from 150,000 Da to 820,000; for example from 150,000 Da to 800,000; such as from 150,000 Da to 780,000; for example from 150,000 Da to 760,000; such as from 150,000 Da to 740,000; for example from 150,000 Da to 720,000; such as from 150,000 Da to 700,000; for example from 150,000 Da to 680,000; such as from 150,000 Da to 660,000; for example from 150,000 Da to 640,000; such as from 150,000 Da to 620,000; for example from 150,000 Da to 600,000; such as from 150,000 Da to 580,000; for example from 150,000 Da to 560,000; such as from 150,000 Da to 540,000; for example from 150,000 Da to 520,000; such as from 150,000 Da to 500,000; for example from 150,000 Da to 480,000; such as from 150,000 Da to 460,000; for example from 150,000 Da to 440,000; such as from 150,000 Da to 420,000; for example from 150,000 Da to 400,000; such as from 150,000 Da to 380,000; for example from 150,000 Da to 360,000; such as from 150,000 Da to 340,000; for example from 150,000 Da to 320,000; such as from 150,000 Da to 300,000; for example from 150,000 Da to 280,000; such as from 150,000 Da to 260,000; for example from 150,000 Da to 240,000; such as from 150,000 Da to 220,000; for example from 150,000 Da to 200,000; such as from 150,000 Da to 180,000; for example from 150,000 Da to 160,000.

Use of Pharmamers

Pharmamers of the present invention can be used both as preventive vaccines and therapeutic vaccines e.g. therapeutic cancer vaccines and therapeutic anti-viral vaccines. They are a powerful tool in various in vivo and ex vivo therapeutic vaccine applications as will be apparent from the following.

The present invention is also based on the recognition that it is possible to design a poly-ligand pharmamer so as to (I) target specific MHC recognising cells, and (II) induce a response as desired, in specific target MHC recognising cells by addressing receptors on such cells. It was further recognised that with such design of MHC molecule/peptide complexes with a given specificity, it is possible to "add" other stimuli to the therapeutic composition by incorporating other molecules, which will affect the activity of the MHC recognising cells. Thus, it is possible to modulate the activity of specifically targeted MHC recognising cell clones, while leaving other MHC recognising cell clones unaffected. Thereby the immune response can be directed aiding the action of the vaccine.

Furthermore, it is also possible to specifically modulate the activity of more than one MHC recognising cell clone by choosing the before-mentioned other molecules appropriately. The inventions is further based on the recognition that it is possible to obtain specific MHC recognising cells using the pharmamers described herein, to modulate such ex vivo, whereby such cells can be used for in vivo vaccination.

By analogy it is possible to direct the efforts of specific pharmamers to other specialized immune cells by using pharmamers that contains molecules that make one of an interacting pair, such as, anti-X antibody-antigen X, X being any membrane bound protein specifying a single or multiple cell types; receptor ligands-membrane bound receptors, i.e. IL-2-1L2 receptor, FasL-FasR.

Accordingly, the present invention provides for methods of up-regulating, down-regulating, modulate, restoring, enhancing, and/or stimulate the immune system, as well as methods of inducing anergy of cells. This can in accordance with the present invention in general be accomplished in two ways, namely in vivo or ex vivo. By "in vivo" is meant that an effective amount of an active substance or ingredient is administered to a subject by any suitable route, the active substance or ingredient exerting its effect in the subject. By "ex vivo" (can also be termed "in vitro") is meant that cells withdrawn from a subject are in some way affected outside the subject, and then re-introduced to the subject, thereby achieving a desired response.

It is to be understood that the therapeutic compositions of the present invention can comprise one or more pharmamers as defined above. The biologically or immunologically active molecules of each pharmamer can be the same or different.

In particular, the inclusion of biologically active molecules can be important to initiate a response as desired. As mentioned above, the immune system is dependent on several signalling pathways, and thus inclusion of biologically active molecules, either as part of pharmamer or alone, can be an excellent way to control or guide the immune system.

Thus, the present invention relates generally to the pharmamers per se as defined above for use as therapeutic and/or preventive vaccines or constituents in vaccines.

The vaccines can suitably comprise one or more adjuvants and/or excipients as described in the foregoing. If more adjuvants are included they may be combined together with a single antigen or all antigens present in the vaccine, or each adjuvant may be combined with one particular antigen.

As used herein, the term "adjuvant" refers to an immunological adjuvant. By this is meant a compound that is able to enhance or facilitate the immune system's response to the ingredient in question, thereby inducing an immune response or series of immune responses in the subject. The adjuvant can facilitate the effect of the therapeutic composition by forming depots (prolonging the half-life of the ingredient), provide additional T-cell help and stimulate cytokine production. Facilitation of antigen survival and unspecific stimulation by adjuvants may, in some cases, be required if the antigenic molecule epitopes or functional molecules of the pharmamer are only weakly antigenic or only exerts weak to moderate interactions with compounds, molecules, or cells of the immune system.

Included in the term "immune response" is specific humoral, i. e. antibody, as well as cellular immune responses, the antibodies being serologic as well as secretory and pertaining to the subclasses IgM, IgD, IgG, IgA and IgE as well as all isotypes, allotypes, and subclasses thereof. The term is further intended to include other serum or tissue components. The cellular response includes Type-1 and Type-2 T-helper lymphocytes, T-17 regulatory T cells, cytotoxic T-cells as well NK cells. Also included herein is the various responses belonging to the innate immune response.

The therapeutic compositions of the invention can suitably be applied in the treatment, prevention, stabilisation, or alleviation of various diseases.

Diseases of relevance are those such as, diseases of inflammatory, auto-immune, allergic, viral, cancerous, infectious, allo- or xenogene (graft versus host and host versus graft) origin. In particular, the disease can be a chronic inflammatory bowel disease such as Crohn's disease or ulcerative colitis, sclerosis, type I diabetes, rheumatoid arthritis, psoriasis, atopic dermatitis, asthma, malignant melanoma, renal carcinoma, breast cancer, lung cancer, cancer of the uterus, prostatic cancer, brain cancer, head and neck cancer, leukaemia, cutaneous lymphoma, hepatic carcinoma, colorectal cancer, bladder cancer, rejection-related disease, Graft-versus-host-related disease, or a viral disease associated with hepatitis, AIDS, measles, pox chicken pox, rubella or herpes.

In a preferred embodiment of the invention, the clinical condition is a cancer. The term "cancer" as used herein is meant to encompass any cancer, neoplastic and preneoplastic disease. Said cancer may for example be selected from the group consisting of colon carcinoma, breast cancer, pancreatic cancer, ovarian cancer, prostate cancer, fibrosarcoma, myxosarcoma, liposarcoma, chondrosarcoma, osteogenic sarcoma, chordoma, angiosarcoma, endotheliosarcoma, lymphangeosarcoma, lymphangeoendothelia sarcoma, synovioma, mesothelioma, Ewing's sarcoma, leiomyosarcoma, rhabdomyosarcoma, squamous cell carcinoma, basal cell carcinoma, adenocarcinoma, sweat gland carcinoma, sebaceous gland carcinoma, papillary carcinoma, papillary adenocarcinomas, cystandeocarcinoma, medullary carcinoma, bronchogenic carcinoma, renal cell carcinoma, hepatoma, bile duct carcinoma, choriocarcinoma, seminoma, embryonal carcinoma, Wilms' tumor, cervical cancer, testicular tumor, lung carcinoma, small cell lung carcinoma, bladder carcinoma, epithelial carcinoma, glioblastomas, neuronomas, craniopharingiomas, schwannomas, glioma, astrocytoma, medulloblastoma, craniopharyngioma, ependymoma, pinealoma, hemangioblastoma, acoustic neuroama, oligodendroglioma, meningioma, melanoma, neuroblastoma, retinoblastoma, leukemias and lymphomas, acute lymphocytic leukemia and acute myelocytic polycythemia vera, multiple myeloma, Waldenstrom's macroglobulinemia, and heavy chain disease, acute nonlymphocytic leukemias, chronic lymphocytic leukemia, chronic myelogenous leukemia, Hodgkin's Disease, non-Hodgkin's lymphomas, rectum cancer, urinary cancers, uterine cancers, oral cancers, skin cancers, stomach cancer, brain tumors, liver cancer, laryngeal cancer, esophageal cancer, mammary tumors, childhood-null acute lymphoid leukemia (ALL), thymic ALL, B-cell ALL, acute myeloid leukemia, myelomonocytoid leukemia, acute megakaryocytoid leukemia, Burkitt's lymphoma, acute myeloid leukemia, chronic myeloid leukemia, and T cell leukemia, small and large non-small cell lung carcinoma, acute granulocytic leukemia, germ cell tumors, endometrial cancer, gastric cancer, cancer of the head and neck, chronic lymphoid leukemia, hairy cell leukemia and thyroid cancer.

More specifically, the disease can be of inflammatory/auto-immune origin, including asthma, hypersensitivity pneumonitis, interstitial lung disease, sarcoidosis, idiopathic pulmonary fibrosis, interstitial lung disease associated with Crohn s Disease or ulcerative colitis or Whipple's disease, interstitial lung disease associated with Wegeners granulomatosis or hypersensitivity vasculitis, vasculitis syndromes, Hennoch-Schonleins purpura, Goodpastures syndrome, Wegeners granulomatosis, renal diseases such as antibody mediated glomerulopathia as in acute glomerulonephritis, nephritis associated with systemic lupus erythematosus, nephritis associated with other systemic diseases such as Wegeners granulomatosis and Goodpastures syndrome and mixed connective tissue disease, chronic interstitial nephritis, chronic glomerulonephritis, gastrointestinal diseases such as Crohn s Disease, Ulcerative colitis, coeliac disease, Whipple's disease, collagenous colitis, eosinophillic colitis, lymphatic colitis, hepatobilliary diseases such as auto-immune hepatitis, alcohol induced hepatitis, periportal fibrosis, primary billiary cirrhosis, sclerosing colangitis, disorders of the central or peripheral nervous system such as demyelinating disease as multiple sclerosis, acute disseminated encephalomyelitis, sub-acute sclerosing panencephalitis, skin disease such as psoriasis, atopic dermatitis, eczema, allergic skin disease, progressive systemic sclerosis (scleroderma), exfoliating dermatitis, pemphigus vulgaris, joint diseases such as rheumatoid arthritis, ankylosing spondylitis, arthritis associated with psoriasis or inflammatory bowel disease, muscoskelletal diseases such as myastenia gravis, polymyositis, endocrine diseases such as insulin dependent diabetes mellitus, auto-immune thyroiditis (Hashimoto), thyreotoxicosis, Graves, diseases of the hematopoetic system such as auto-immune anaemia, auto-immune thrombocytopenia, cardiovascular diseases such as cardiomyopathia, vasculitis, cardiovascular disease associated with systemic diseases as systemic lupus erythematosus, polyarthritis nodosa, rheumatoid arthritis, scleroderma, sarcoidosis, diseases of cancerous origin, including malignant melanoma, Sezary's syndrome, cutaneous T-cell lymphoma, renal cell carcinoma, colorectal cancer, breast cancer, ovarian cancer, cancer of the uterus, prostatic cancer, hepatic carcinoma, lung cancer, and sarcoma, diseases, disorders or conditions of allergic origin.

In one embodiment the invention relates to treatment of one or more autoimmune diseases. Autoimmune diseases may be loosely grouped into those primarily restricted to specific organs or tissues and those that affect the entire body. Examples of organ-specific disorders (with the organ affected) include multiple sclerosis (myelin coating on nerve processes), type I diabetes mellitus (pancreas), Hashimotos thyroiditis (thyroid gland), pernicious anemia (stomach), Addison's disease (adrenal glands), myasthenia gravis (acetylcholine receptors at neuromuscular junction), rheumatoid arthritis (joint lining), uveitis (eye), psoriasis (skin), Guillain-Barre Syndrome (nerve cells) and Grave's disease (thyroid). Systemic autoimmune diseases include systemic lupus erythematosus and dermatomyositis.

In another embodiment the invention relates to treatment of one or more hypersensitivity disorders. Examples of hypersensitivity disorders include asthma, eczema, atopical dermatitis, contact dermatitis, other eczematous dermatitides, seborrheic dermatitis, rhinitis, Lichen planus, Pemplugus, bullous Pemphigoid, Epidermolysis bullosa, uritcaris, angioedemas, vasculitides, erythemas, cutaneous eosinophilias, Alopecia areata, atherosclerosis, primary biliary cirrhosis and nephrotic syndrome. Related diseases include intestinal inflammations, such as Coeliac disease, proctitis, eosinophilia gastroenteritis, mastocytosis, inflammatory bowel disease, Chrohn's disease and ulcerative colitis, as well as food-related allergies.

The most common allergens, to which allergic reactions occur, include. inhalation allergens originating i. a. from trees, grasses, herbs, fungi, house dust mites, storage mites, cockroaches and animal hair, feathers, and dandruff. Important pollen allergens from trees, grasses and herbs are such originating from the taxonomic orders of Fagales, Oleales and Pinales including i. a. birch (*Betula*), alder (*Alnus*), hazel (*Corylus*), hornbeam (*Carpinus*) and olive (*Olea*), the order of Poales including i. a. grasses of the genera *Lolium, Phleum, Poa, Cynodon, Dactylis* and *Secale*, the orders of Astrales and Urticales including i. a. herbs of the genera *Ambrosia* and *Artemisia*. Important inhalation allergens from fungi are i. a. such originating from the genera *Alternaria* and *Cladosporium*. Other important inhalation allergens are those from house dust mites of the genus *Dermatophagoides*, storage mites from the genus Lepidoglyphys destructor, those from cockroaches and those from mammals such as cat, dog, horse, cow, and bird. Also, allergic reactions towards stinging or biting insects such as those from the taxonomic order of Hymenoptera including bees, wasps, and ants are commonly observed. Specific allergen components are known to the person skilled in the art and include e. g. Bet v 1 (*B. verrucosa*, birch), Aln g 1 (*Alnus glutinosa*, alder), Cor a 1 (*Corylus avelana*, hazel) and Car b 1 (*Carpinus betulus*, hornbeam) of the Fagales order. Others are Cry j 1 (Pinales), Amb a 1 and 2, Art v 1 (Asterales), Par j 1 (Urticales), Ole e 1 (Oleaves), Ave e 1, Cyn d 1, Dac g 1, Fes p 1, Hol 1 1, Lol p 1 and 5, Pas n 1, Phl p 1 and 5, Poa p 1, 2 and 5, Sec c 1 and 5, and Sor h 1 (various grass pollens), Alt a 1 and Cla h 1 (fungi), Der f 1 and 2, Der p 1 and 2 (house dust mites, *D. farinae* and *D. pteronyssinus*, respectively), Lep d 1, Bla g 1 and 2, Per a 1 (cockroaches, *Blatella germanica* and *Periplaneta americana*, respectively), Fel d 1 (cat), Can f 1 (dog), Equ c 1, 2 and 3 (horse), Apis m 1 and 2 (honeybee), Ves g 1,2 and 5, Pol a 1, 2 and 5 (all wasps) and Sol i 1, 2, 3 and 4 (fire ant), to mention the most common.

Compositions

The therapeutic compositions of the invention can be formulated in any suitable way, i. a. depending on the route of administration, and the amount of active ingredient to be administered. In particular, the therapeutic compositions of the invention can be formulated for parenteral administration, including intravenous, intramuscular, intraarticular, subcutaneous, intradermal, epicantous/transdermal, and intra-peritoneal administration, for infusion, for oral administration, for nasal administration, for rectal administration, for vaginal administration, or for topic administration.

The pharmamer can suitably be immobilised onto a solid or semi-solid support. Examples of solid and semi-solid support are those mentioned above, i. e. particles, beads, biodegradable particles, sheets, gels, filters, membranes, fibres, capillaries, needles, microtitre strips, tubes, plates or wells, combs, pipette tips, micro arrays, and chips. In particular, the solid support can be selected from particles and beads, preferably particles and beads, which are polymeric, magnetic or superparamagnetic. For in vivo therapy, biodegradable particles will be especially preferred, while for ex vivo therapy, biodegradable, polymeric, magnetic, paramagnetic or superparamagnetic particles will be especially preferred.

As mentioned, the pharmamers used in therapeutic vaccine settings are very interesting molecule poly-ligand compounds possessing highly appropriate properties for modulation of various immune cells both in vivo and ex vivo.

The poly-ligand pharmamers can, due to the one or more multimerization domain(s), be loaded with a plurality of biologically or immunologically active molecules to ensure high avidity binding to specific counter receptors.

It is to be understood that such responses include inducing anergy leading to apoptosis, up-regulating a response, down-regulating a response, stimulating a response, modulating a response, enhancing a response, inhibiting a response, and in any other way manipulating a response. In this connection, it should be understood that the MHC molecules/peptides of the construct can be chosen so as to induce a number of other responses, or activate signal pathways which results in the production of various signalling substances which can have a beneficial influence on the disease to be treated, prevented or alleviated.

Furthermore, this desired effect of one or more of the molecules of a pharmamer can be ameliorated, enhanced, reduced, inhibited, stimulated or combined with other effects by the further attachment of other biologically active compounds as described above.

A variety of diseases, including cancer causes immunosuppression in the patients. Immunotherapy using therapeutic vaccines is an attempt to stimulate the patient's own immune system to recognise and destroy cancer cells. The tumour can exert its suppressive influence over the immune system through several different mechanisms. Although tumour cells can prime the immune system, tumour escape mechanisms can induce immunological tolerance to the tumour. There are several known mechanisms of tumour escaping immune surveillance. For instance, tumour cells are often inefficient in presenting tumour antigens to effector T-cells. This can be the result of tumour cell down-regulation or mutation of MHC molecules, or down-regulation of co-stimulatory molecules such as B7, or other molecules, such as TAP, that are important in the antigen presenting pathway.

Furthermore, tumour cells have been shown to induce tolerance in T-cells by down-regulating the expression of CD3-zeta chain in T-cells. Tumour cells can also suppress T-cell activation by release of inhibitory cytokines, and induce apoptosis in T-cells through Fas-Fas ligand interaction. Tumour cells also have the ability to suppress the immune system through release of cytokines such as IL-12 that inhibits the maturation of immature dendritic cells into fully mature antigen presenting cells. Inhibitory factors released by tumour cells have been shown to suppress granulocyte activation, thus avoiding the killing of tumour cells by activated granulocytes.

Common treatment regimes such as chemotherapy and radiation therapy also suppress immunity in a more general way. It is also known that the immune suppression that HIV infection cause leads to destruction of immune function cells.

A variety of different prior art strategies have been employed in an attempt to restore or enhance the patient's immune response to tumours, including treatment with monoclonal antibodies, cancer vaccines, cytokine therapy and adoptive cellular immunotherapy using dendritic cells or T-cells. Cellular immunotherapy involving T-cells include CD8+ cytotoxic effector cells that have the capacity to kill tumour cells. Furthermore, it has been shown that CD4+ cytokine producing T-cells also play an important role in maintaining a sustainable anti-tumour cell activity of cytotoxic CD8 cells. The success, however, of the prior art methods have been limited.

As mentioned the present invention relates to methods for the vaccine treatment of human beings and animals, comprising methods of administering a pharmammer as described herein in an effective amount.

The treatment can be such which involves up-regulation, down-regulation, modulation, stimulation, inhibition, restoration, enhancement and/and otherwise manipulation of immune responses. This can indeed be accomplished by the compositions of the present invention. The present invention also relates to methods of inducing anergy in a cell, by which methods a therapeutic composition as described herein is administered.

In a further aspect, the present invention relates to methods of performing adoptive immunotherapy, which methods comprise administrating to an animal, including a human being, a therapeutic composition as described herein.

As mentioned above, the therapeutic composition of the invention is suited for in vivo therapy.

The present invention further comprise pharmamer compositions for therapeutic and preventive vaccines that suitably comprise from 1 to 3, 1 to 4, 1 to 5, 1 to 6, 1 to 7, 1 to 8, 1 to 9, 1 to 10, or 1 to more than 10; 2 to 3, 2 to 4, 2 to 5, 2 to 6, 2 to 7, 2 to 8, 2 to 9, 2 to 10, or 2 to more than 10; 3 to 4, 3 to 5, 3 to 6, 3 to 7, 3 to 8, 3 to 9, 3 to 10, or 3 to more than 10; 4 to 5, 4 to 6, 4 to 7, 4 to 8, 4 to 9, 4 to 10, or 4 to more than 10; 5 to 6, 5 to 7, 5 to 8, 5 to 9, 5 to 10, or 5 to more than 10; 6 to 7, 6 to 8, 6 to 9, 6 to 10, or 6 to more than 10; 7 to 8, 7 to 9, 7 to 10, or 7 to more than 10; 8 to 9, 8 to 10, or 8 to more than 10; 9 to 10, or 9 to more than 10 different biologically active molecules.

Thus, the inclusion of two, three, four, five, six or more different biologically active molecules are contemplated and believed to be advantageous in some cases. The different molecules can be attached on the multimerization domain in any desired fixed ratio e.g. for a pharmamer with three different molecules termed A, B, and C, ratios such as but not limited to, 1:1:1, 1:2:1, 1:3:1, 1:4:1, 1:5:1, 2:1:1, 2:1:2, 2:3:2, 3:5:8, etc. and for a pharmamer with five different molecules attached, termed G, H, I, J, and K, ratios such as but not limited to, 2:4:3:6:5, 4:6:8:1:1, 10:1:2:5:2, etc. may apply. One or more of the molecules can be functioning as an adjuvant. Adjuvants or biologically active molecules or other ingredients may also be constituents of the final vaccine without being attached to the multimerization domain. These non-pharmamer vaccine constituents can be mixed with the pharmamer in any suitable ratio(s).

Dosage, Administration and Preparation

The individual to receive the vaccine composition according to the present invention may be any individual in need thereof, preferably a mammal in need thereof, more preferably a human being in need thereof, such as a newborn, a child, an adult, a woman or a man.

In one preferred embodiment the vaccine composition is administered prophylactically and in this embodiment the individual in need thereof, may be any individual at risk of encountering the given clinical condition against which the vaccine composition is directed.

When selecting biologically active molecules to be used in a pharmamer one needs to carefully consider the possibilities of unwanted adverse or serious adverse reactions.

It is further contemplated that the amount of pharmamer construct required to induce a systemic immune response will typically be in the range of from 0.0001 to 10000 ug/kg/dose, such as from 0.01 to 1000 ug/kg/dose, from 0.1 to 100 ug/kg/dose, or from 1 to 10 ug/kg/dose.

In one embodiment, each dosage unit of said vaccine composition preferably comprises in the range of 0.01 to 1 µg, such as in the range of 0.05 to 1 µg, for example in the range of 0.1 to 1 µg, such as in the range of 0.05 to 1 µg, for example in the range of 0.1 to 1 µg, such as in the range of 0.05 to 0.8 µg, for example in the range of 0.05 to 0.6 µg, such as in the range of 0.05 to 0.4 µg, for example in the range of 0.05 to 0.2 µg, such as in the range of 0.1 to 0.8 µg, for example in the range of 0.1 to 0.6 µg, such as in the range of 0.1 to 0.5 µg, for example in the range of 0.1 to 0.4 µg, such as in the range of 0.1 to 0.3 µg, for example in the range of 0.1 to 0.2 µg of the pharmamer or peptide of the present invention.

In one embodiment the daily dosage of the pharmamer may be varied over a wide range from 0.001 to 1,000 mg per adult human/per day. For oral administration, the compositions are preferably provided in the form of scored or unscored tablets containing 0.01, 0.05, 0.1, 0.5, 1.0, 2.5, 5.0, 10.0, 15.0, 25.0, and 50.0 milligrams of the active ingredient for the symptomatic adjustment of the dosage to the patient to be treated. An effective amount of the drug is ordinarily supplied at a dosage level of from about 0.0001 mg/kg to about 100 mg/kg of body weight per day. The range is more particularly from about 0.001 mg/kg to 10 mg/kg of body weight per day. Even more particularly, the range varies from about 0.05 to about 1 mg/kg.

Of course the dosage level will vary depending upon the potency of the particular compound. Certain compounds will be more potent than others. In addition, the dosage level will vary depending upon the bioavailability of the compound. The more bioavailable and potent the compound, the less compound will need to be administered through any delivery route, including but not limited to oral delivery.

The amount of the immunogenic peptide of the invention in the pharmaceutical composition may vary, depending on the particular application. However, a single dose of the immunogen is in one embodiment preferably anywhere from about 10 µg to about 5000 µg, more preferably from about 50 µg to about 2500 µg such as about 100 µg to about 1000 µg.

Modes of administration include intradermal, subcutaneous and intravenous administration, implantation in the form of a time release formulation, etc. Any and all forms of administration known to the art are encompassed herein. Also any and all conventional dosage forms that are known in the art to be appropriate for formulating injectable immunogenic peptide composition are encompassed, such as lyophilised forms and solutions, suspensions or emulsion forms containing, if required, conventional pharmaceutically acceptable carriers, diluents, preservatives, adjuvants, buffer components, etc.

The vaccine compositions may be administered in any suitable manner. For example the vaccine compositions may be administered enterally, parenterally, transdermally, orally, by inhalation and/or over a mucosal membrane.

In a preferred embodiment, the vaccine compositions are administered parenterally. Examples of parenteral routes of administration include injections and infusions, e.g. intravenous, intraarterial, intramuscular, intracardial, subcutaneous, intraosseous, intradermal, intraperitonal or intrethecal. A preferred route of parenteral administration of the vaccine comporision is by subcutaneous injection. A suitable administration form for parenteral administration is a solution or dispersion.

Pharmammer vaccine compositions administered more than once can be administered by same route or by alternating routes. Similarly the individual components of the vaccine can be administered alone or in combinations by the same route or by alternating/mixed routes In some embodiments of the present invention it is desirable that the pharmaceutical composition comprises an isotonic agent. In particular when the pharmaceutical composition is prepared for administration by injection or infusion it is often desirable that an isotonic agent is added.

Accordingly, the composition may comprise at least one pharmaceutically acceptable additive which is an isotonic agent.

The pharmaceutical composition may be isotonic, hypotonic or hypertonic. However it is often preferred that a pharmaceutical composition for infusion or injection is essentially isotonic, when it is administrated. Hence, for storage the pharmaceutical composition may preferably be isotonic or hypertonic. If the pharmaceutical composition is hypertonic for storage, it may be diluted to become an isotonic solution prior to administration.

The isotonic agent may be an ionic isotonic agent such as a salt or a non-ionic isotonic agent such as a carbohydrate.

Examples of ionic isotonic agents include but are not limited to NaCl, $CaCl_2$, KCl and $MgCl_2$. Examples of non-ionic isotonic agents include but are not limited to mannitol, sorbitol and glycerol.

It is also contained within the present invention that at least one pharmaceutically acceptable additive is a buffer. For some purposes, for example, when the pharmaceutical composition is meant for infusion or injection, it is often desirable that the composition comprises a buffer, which is capable of buffering a solution to a pH in the range of 4 to 10, such as 5 to 9, for example 6 to 8.

However, in other embodiments of the invention the pharmaceutical composition may comprise no buffer at all or only micromolar amounts of buffer.

The buffer may for example be selected from the group consisting of TRIS, acetate, glutamate, lactate, maleate, tartrate, phosphate, citrate, carbonate, glycinate, histidine, glycine, succinate and triethanolamine buffer.

TRIS buffer is known under various other names for example tromethamine including tromethamine USP, THAM, Trizma, Trisamine, Tris amino and trometamol. The designation TRIS covers all the aforementioned designations.

The buffer may furthermore for example be selected from USP compatible buffers for parenteral use, in particular, when the pharmaceutical formulation is for parenteral use. For example the buffer may be selected from the group consisting of monobasic acids such as acetic, benzoic, gluconic, glyceric and lactic, dibasic acids such as aconitic, adipic, ascorbic, carbonic, glutamic, malic, succinic and tartaric, polybasic acids such as citric and phosphoric and bases such as ammonia, diethanolamine, glycine, triethanolamine, and TRIS.

The vaccine composition may also comprise antioxidants and/or reducing agents for example acetone sodium bisulfite, ascorbate, bisulfite sodium, butylated hydroxy anisole, butylated hydroxy toluene, cystein/cysteinate HCL, dithionite sodium, gentisic acid, gentisic acid ethanolamine, glutamate monosodium, formaldehyde sulfoxylate sodium, metabisulfite potassium, metabisulfite sodium, monothioglycerol, propyl gallate, sulfite sodium and thioglycolate sodium.

In another embodiment the vaccine composition is administered transdermally. Examples of useful administration forms for transdermal administration include ointment, gel, cream, gel-like cream, paste, liquid, lotion, aerosol, spray, liniment, plaster, poultice, foam, bath admixture, a patch and a bandage. Preferably, if the vaccine composition is to be administered transdermally, it is preferably in the form of a patch.

Ointments, lotions, creams and the like may be prepared as described in Remington "The science and practice of pharmacy", chapter 44 pages 845-851, $20^{th}$ edition. Patches for transdermal vaccines may be prepared by any conventional methods, for example as described in EP1384403 or WO2004/030696. Preferably patches for transdermal vaccines are prepared essentially as described in Examples 4 to 13 of WO2004/03069 except that the transdermal patches should comprise the vaccine composition according to the present invention. The skilled person will readily be able to make the required adaptations.

For inhalation the vaccine composition may be administered in the form of an aerosol and/or spray dosage form which can be prepared, for example, by filling an aerosol container with above-mentioned solution for example, together with an injection agent such as liquefied petroleum gas. A poultice can be prepared by adding the above mentioned vaccine composition to an ointment base formed from a partially neutralized polyacrylic acid, sodium polyacrylate, and the like.

For oral administration, the vaccine composition may be administered in the form of a tablet, capsule, drop, liquid mixture or powder. Tablet, capsules, and drops may be swallowed or chewed. Oral administration may result in uptake via the mucosa in the mouth, such as buccal or sublingual uptake, and/or in uptake via the gastro-intestinal route, such as uptake over the mucosa of the intestines.

As the pH adjuster, for example, lactic acid, citric acid, phosphoric acid and the like can be mentioned for adjusting to a lower pH range, and sodium hydroxide, potassium hydroxide, sodium lactate, sodium citrate, monoethanolamine and diisopropanolamine and the like can be mentioned for adjusting to a higher pH range. Addition of carboxyvinyl polymer, which is a water-soluble polymer, can also achieve a lower pH. Buffers such as acetate buffer, a phosphate buffer, a citrate buffer, a succinate buffer or TRIS may also be included for pH adjustment.

As the stabilizer, for example, ascorbic acid, dibutylhydroxytoluene, sodium thiosulfate, sodium thioglycolate, sodium thiomalate, erythorbic acid, sodium erythorbate, sodium pyrosulfite, benzoic acid, sodium benzoate, sodium alginate, sodium caprylate, L-arginine, L-cysteine, dl-.alpha.-tocopherol, tocopherol acetate, propyl gallate, disodium edetate and the like can be mentioned.

As the preservative, for example, benzethonium chloride, benzalkonium chloride, methylparaben, ethylparaben, propylparaben, chlorobutanol, benzyl alcohol, thimerosal and the like can be mentioned.

The vaccine compositions of the present invention may also be administered over a mucosal membrane. Thus, the vaccine composition may be applied to any mucous membrane including the conjunctiva, nasopharynx, orthopharnyx, vagina, colon, urethra, urinary bladder, lung, large (rectal) and small (enteral) intestine.

When administered ocularly or nasally, the compositions of the present invention can be formulated in an aqueous solution buffered to a pH of between 3.0 and 8.0, most preferably pH 5.0-5.4, by means of a pharmaceutically acceptable buffer system. Any pharmaceutically acceptable buffering system capable of maintaining the pH in the preferred ranges can be used in the practice of this invention. A typical buffer will be, for example, an acetate buffer, a phosphate buffer, a citrate buffer, a succinate buffer, or the like. The concentration of buffer is typically in the range from between 0.005 and 0.1 molar, most preferably about 0.02 molar.

The container, e.g. nasal applicator or eye drop bottle, may contain sufficient composition for a single nasal or ocular dosing or for several sequential dosages.

In one embodiment of the invention, the vaccine compositions of the present invention may be formulated for sustained release. For example, one or more of the immune stimulating complex, carrier protein, saccharide antigen and/or aluminium containing adjuvant may be combined with a silicone elastomer that releases the saccharide antigen over a long period of time. The silicone elastomer can also comprise albumin. See U.S. Pat. No. 4,985,253, the contents of which are fully incorporated by reference herein. The release rate of the antigen from the silicone elastomer can be controlled by incorporation of a water soluble or fat soluble mixing agent or cosolvent (e.g., polyethylene glycol 400, polysorbate 80, sodium alginate, L-alanine, sodium chloride, polydimethylsiloxane) into the silicone elastomer. Any other additive can also be incorporated into the silicone elastomer for the purpose of accelerating the release rate.

The vaccine composition according to the invention may be formulated into unit dosage forms, wherein each unit, for example a sealed container, comprises one dosage of the vaccine composition.

The vaccine compositions may be administered once; however, more often the vaccine compositions are administered more than once, such as more than 2 times, for example more than 5 times, such as more than 10, for example more than 15, such as more than 20, for example more than 30 times, such as more than 50 times, for example more than 100 times. Preferably, the vaccine compositions are administered in the range of 2 to 10 times, more preferably in the range of 2 to 5 times, such as twice.

When the vaccine composition is administered more than once, the time period between two individual administrations is typically in the range of 1 week to 5 years, such as in the range of 1 month to 2 year, for example in the range of 1 month to 1 year, such as in the range of 2 months to 7 months. If the vaccine composition is administered more than twice, then the time period between the individual administrations may each individually be any of the aforementioned. Thus by way of example the interval between the first and second administration may be around 2 months and the interval between the second and the third administration may be around 7 months.

In one embodiment the pharmamer based vaccines can be administered by several routes including but not limited to injection including intravenously, intramuscularly, subcutaneously, inter peritoneal injection and transmucosally (nasal, rectal, vaginal) application, by inhalation, per-orally or by inoculation.

The administration of pharmamers of the invention can be as single doses or as several doses. In certain cases, administration only once can be sufficient. In general, several doses should be given with intervals of a day, a week, two weeks, a month, or several months, etc. For example, a single dose can be given once, or a dose can be given as a primer, followed by one or more administration, or a continuous administration regime like up to four doses per week, followed by one month without administrations, followed by up to four doses per week. Further but not limiting examples are vaccination protocols where administration is performed on week 0, 4, 8, and 16; or on week 0, 2, 4, 6, 8, 10, 12, and 14; or on week 0, 5, 11, 17; or on month 0, 1, and 2; or on day 0, 7, and 30; or every year. Optionally with increasing amount of pharmamer; optionally with modified ratios of the biologically active molecules of the pharmamer construct; optionally using different adjuvants or combinations of adjuvants in the different administrations. Administration protocol can also be linked to age of the vaccine. Known examples are childhood vaccines. Examples of age related protocols, at the age of 3 month, 5, month, and 12 month; or 3 month, 5, month, 12 month, and 5 years; or 15 month, and 4 years. These examples are not exhaustive. The optimal administration regime depends on the pharmamer construct in question and several other factors. The person skilled in the art will readily know how to optimise this.

Of course, other medicaments can be administered simultaneously in order to enhance or support the vaccine treatment.

Containers for mixing and storage of the pharmamers of the invention can be made of glass or various polymeric materials. The containers chosen should not adsorb the product stored. The containers can suitably be ampoules or capped vials for mono- or multi-dosage.

The invention further relates to methods for producing the pharmamers of the invention, which methods comprise providing a pharmamer as described herein, and solubilising or dispersing (i.e. in suspension) the pharmamer in a medium suitable for therapeutic substances, and optionally adding other adjuvants and/or excipients. The medium can be in the form of a liquid, a gel, or an ointment. The pharmamer can also be embedded in a matrix being part of a solid pill, or powder inside a capsule.

As described herein the pharmamers can be useful as vaccines, as vaccine components or as engineered intelligent adjuvants. The possibility of creating pharmamers that specifically bind certain T cells with molecules that trigger, e.g. the humoral response or the innate immune response, can accelerate vaccine development and improve the efficiency of vaccines.

Vaccine compositions may be prepared and administered using any conventional protocol known by a person skilled in the art. Below is a non-limiting example of preparation of a vaccine composition according to the invention is given as well as a non-limiting example of administration of such as a vaccine. It will be appreciated by the person skilled in the art that the protocol may be easily adapted to any of the vaccine compositions described herein.

The peptides can e.g. be synthesized e.g. at the UVA Biomolecular Core Facility with a free amide $NH_2$ terminus and free acid COOH terminus. Each was provided as a lyophilized peptide, which was then reconstituted in sterile water and diluted with Lactated Ringer's solution (LR, Baxter Healthcare, Deerfield, Ill.) as a buffer for a final concentration of 67-80% Lactated Ringer's in water. These solutions were then sterile-filtered, placed in borosilicate glass vials, and submitted to a series of quality assurance studies including confirmation of identity, sterility, general safety, and purity, in accordance with FDA guidelines, as defined in IND 6453.

In practical circumstances, patients will receive a vaccine comprising about 100 μg of a class I HLA-restricted HIV peptide with or without a class II HLA-restricted HIV helper peptide. The patients are vaccinated with e.g. about 100 μg of the class I HLA peptide in adjuvant alone, or vaccinated with e.g. about 100 μg of the HLA class I-restricted peptide plus 190 μg of the class II-restricted helper peptide. The higher dose of the helper peptide is calculated to provide equimolar quantities of the helper and cytotoxic epitopes. Additionally, patients can be vaccinated with a longer peptide comprising the amino acid sequences of both peptides.

The above peptides, in 1-ml aqueous solution, can be administered either as a solution/suspension with about 100 µg of QS-21, or as an emulsion with about 1 ml of Montanide ISA-51 adjuvant.

Patients are immunized e.g. at day 0 and months 1, 2, 3, 6, 9, and 12, with the peptide pharmamer plus adjuvant, for a total of seven immunizations. With rare exceptions, the vaccinations are administered to the same arm with each vaccine. The peptide pharmamers are administered s.c.

Adjuvants

Pharmamer vaccines of the present invention may be combined with adjuvant in order to improve the effect of the vaccine. Adjuvants are pharmacological or immunological agents that modify the effect of other agents (e.g. vaccines and drugs) while having few if any direct effects when given by themselves.

Adjuvants can be mixed with the vaccine and administered simultaneously with the vaccine. The adjuvant can be attached to one or more components of the vaccine by covalent or non-covalent interaction or be in the vaccine as an individual component. The adjuvant may also be administered before or after the vaccine is administered. More than one type of adjuvant can be used together with a given vaccine likewise one specific type of adjuvant may be used for more than one vaccine.

Immunological adjuvants are substances that stimulate the immune system and increase the response to a vaccine without having any specific antigenic effect itself. An immunological adjuvant either potentiates the immune responses to an antigen and/or modulates it towards the desired immune responses.

More than one adjuvant may be present in the final vaccine product. They may be combined together with a single antigen or all antigens present in the vaccine, or each adjuvant may be combined with one particular antigen.

Examples of immunological adjuvants include oil emulsions and surfactant based formulations e.g. MF59, QS21, AS02, Montanide ISA-51, ISA-720, Titermax gold, mineral salts (e.g. aluminiumhydroxide, aluminiumhydroxide gel, aluminium or calcium phosphate gels), particulate adjuvants (e.g. virosomes, AS04, immune stimulatory complexes (ISCOMs), polylactide co-glycolide (PLG)), natural and synthetic microbial derivatives (e.g. monophosphoryl lipid A (MPL), Detox (MPL+*M. Phlei* cell wall skeleton), AGP [RC-529] (synthetic acylated monosaccharide), DC_Chol (lipoidal immunostimulators able to self organize into liposome's), OM-174 (lipid A derivative), CpG motifs (synthetic oligonucleotides containing immunostimulatory CpG motifs), modified LT and CT (genetically modified bacterial toxins to provide non-toxic adjuvant effects), endogenous human immunomodulators, (e.g., hGM-CSF or hIL-12 (cytokines that can be administered either as protein or plasmid encoded), Immudaptin (C3d tandem array)), saponins, squalene or phosphate based adjuvants, lipopolysaccharides, Inert vehicles, such as gold particles microbial antigens, copolymers.

Adjuvant pertaining to the present invention may be grouped according to their origin, be it mineral, bacterial, plant, synthetic, or host product. The first group under this classification are the mineral adjuvants, such as aluminium compounds. Antigens precipitated with aluminum salts or antigens mixed with or adsorbed to performed aluminum compounds have been used extensively to augment immune responses in animals and humans. Aluminum particles have been demonstrated in regional lymph nodes of rabbits seven days following immunization, and it may be that another significant function is to direct antigen to T cell containing areas in the nodes themselves. Adjuvant potency has been shown to correlate with intimation of the draining lymph nodes. While many studies have confirmed that antigens administered with aluminum salts led to increased humoral immunity, cell mediated immunity appears to be only slightly increased, as measured by delayed-type hypersensitivity. Aluminum hydroxide has also been described as activating the complement pathway. This mechanism may play a role in the local inflammatory response as well as immunoglobulin production and B cell memory. Primarily because of their excellent record of safety, aluminum compounds are presently the only adjuvants used in humans.

While aluminum salts have been a sufficient adjuvant for strong immunogens that require only antibody responses to elicit protection, they may not always be effective when used with weak immunogens such as e.g. synthetic peptides of malaria, or for introducing cell-mediated immune responses or IgG isotype of the type required to fight infections. Thus, the immunostimulating fragment of TGF according to the present invention may in one embodiment act as an adjuvant or immunostimulator and may be conjugated or non-conjugated to the immunogenic determinant against which it is desirable to raise an immune response.

Another large group of adjuvants are those of bacterial origin. Adjuvants with bacterial origins can be purified and synthesized (e.g. muramyl dipeptides, lipid A) and host mediators have been cloned (Interleukin 1 and 2). The last decade has brought significant progress in the chemical purification of at least three adjuvants of active components of bacterial origin: *Bordetella pertussis*, lipopolysaccharide and Freund's Complete Adjuvant (FCA). Additionally suitable adjuvants in accordance with the present invention are e.g. Titermax, ISCOMS, Quil A, and ALUN, see US 58767 and U.S. Pat. No. 5,554,372, Lipid A derivatives, choleratoxin derivatives, HSP derivatives, LPS derivatives, synthetic peptide matrixes, GMDP, and other as well as combined with immunostimulants (U.S. Pat. No. 5,876,735).

*B. pertussis* is of interest as an adjuvant in the context of the present invention due to its ability to modulate cell-mediated immunity through action on T-lymphocyte populations. For lipopolysaccharide and Freund's Complete Adjuvant, adjuvant active moieties have been identified and synthesized which permit study of structure-function relationships. These are also considered for inclusion in immunogenic compositions according to the present invention.

Lipopolysaccharide and its various derivatives, including lipid A, have been found to be powerful adjuvants in combination with liposome's or other lipid emulsions. It is not yet certain whether derivatives with sufficiently low toxicity for general use in humans can be produced. Freund's Complete Adjuvant is the standard in most experimental studies.

Endogenous human immunomodulators are another group of adjuvants of interest for the present invention and among others include cytokines, interleukins, interferons and growth factors. These immunomodulators can be administered either as protein or plasmid encoded.

Many other types of materials can be used as adjuvants in immunogenic compositions according to the present invention. They include plant products such as saponin, animal products such as chitin, inert vehicles, such as gold particles and numerous synthetic chemicals.

Adjuvants according to the present invention can also be categorized by their proposed mechanisms of action. This type of classification is necessarily somewhat arbitrary because most adjuvants appear to function by more than one mechanism. Adjuvants may act through antigen localization and delivery, or by direct effects on cells making up the immune system, such as macrophages and lymphocytes. Another mechanism by which adjuvants according to the invention enhance the immune response is by creation of an antigen depot. This appears to contribute to the adjuvant activity of aluminum compounds, oil emulsions, liposomes, and synthetic polymers. The adjuvant activity of lipopolysaccharides and muramyl dipeptides appears to be mainly mediated through activation of the macrophage, whereas *B. pertussis* affects both macrophages and lymphocytes. Further examples of adjuvants that may be useful when incorporated into immunogenic compositions according to the present invention are described in U.S. Pat. No. 5,554,372.

At present only a few of the above mentioned adjuvants are approved for human use. Most relevant in this aspect are Alhydrogel (Aluminium Hydroxide), MF59 and the proprietary Montanide ISA720.

In one embodiment adjuvants are any substance whose admixture into the vaccine composition increases or otherwise modifies the immune response to the pharmamers of the present invention.

Adjuvants could for example be selected from the group consisting of: $AlK(SO_4)_2$, $AlNa(SO_4)_2$, $AlNH_4(SO_4)$, silica, alum, $Al(OH)_3$, $Ca_3(PO_4)_2$, kaolin, carbon, aluminum hydroxide, muramyl dipeptides, N-acetyl-muramyl-L-threonyl-D-isoglutamine (thr-DMP), N-acetyl-nornuramyl-L-alanyl-D-isoglutamine (CGP 11687, also referred to as nor-MDP), N-acetylmuramyul-L-alanyl-D-isoglutaminyl-L-alanine-2-(1'2'-dipalmitoyl-sn-glycero-3-hydroxphosphoryloxy)-ethylamine (CGP 19835A, also referred to as MTP-PE), RIBI (MPL+TDM+CWS) in a 2% squalene/Tween-80® emulsion, lipopolysaccharides and its various derivatives, including lipid A, Freund's Complete Adjuvant (FCA), Freund's Incomplete Adjuvants, Merck Adjuvant 65, polynucleotides (for example, poly IC and poly AU acids), wax D from *Mycobacterium*, tuberculosis, substances found in *Corynebacterium parvum, Bordetella pertussis*, and members of the genus *Brucella*, liposomes or other lipid emulsions, Titermax, ISCOMS, Quil A, ALUN (see US 58767 and U.S. Pat. No. 5,554,372), Lipid A derivatives, choleratoxin derivatives, HSP derivatives, LPS derivatives, synthetic peptide matrixes or GMDP, Interleukin 1, Interleukin 2, Montanide ISA-51 and QS-21. Preferred adjuvants to be used with the invention include Montanide ISA-51 and QS-21.

Montanide ISA-51 (Seppic, Inc.) is a mineral oil-based adjuvant analogous to incomplete Freund's adjuvant, which must be administered as an emulsion. QS-21 (Antigenics; Aquila Biopharmaceuticals, Framingham, Mass.) is a highly purified, water-soluble saponin that handles as an aqueous solution. QS-21 and Montanide ISA-51 adjuvants can be provided in sterile, single-use vials.

Additional preferred adjuvants capable of being used in vaccine compositions comprising one or more of the pharmamers of the present invention are e.g. any substance which promote an immune responses. Frequently, the adjuvant of choice is Freund's complete or incomplete adjuvant, or killed *B. pertussis* organisms, used e.g. in combination with alum precipitated antigen. A general discussion of adjuvants is provided in Goding, Monoclonal Antibodies: Principles & Practice (2nd edition, 1986) at pages 61-63. Goding notes, however, that when the antigen of interest is of low molecular weight, or is poorly immunogenic, coupling to an immunogenic carrier is recommended. Examples of such carrier molecules include keyhole limpet haemocyanin, bovine serum albumin, ovalbumin and fowl immunoglobulin. Various saponin extracts have also been suggested to be useful as adjuvants in immunogenic compositions. Recently, it has been proposed to use granulocyte-macrophage colony stimulating factor (GM-CSF), a well known cytokine, as an adjuvant (WO 97/28816).

Desirable functionalities of adjuvants capable of being used in accordance with the present invention are listed in the below table.

| Modes of adjuvant action | | |
| --- | --- | --- |
| Action | Adjuvant type | Benefit |
| 1. Immunomodulation | Generally small molecules or proteins which modify the cytokine network | Upregulation of immune response. Selection of Th1 or Th2 |
| 2. Presentation | Generally amphipathic molecules or complexes which interact with immunogen in its native conformation | Increased neutralizing antibody response. Greater duration of response |
| 3. CTL induction | Particles which can bind or enclose immunogen and which can fuse with or disrupt cell membranes w/o emulsions for direct attachment of peptide to cell surface MHC-1 | Cytosolic processing of protein yielding correct class 1 restricted peptides Simple process if promiscuous peptide(s) known |
| 4. Targeting | Particulate adjuvants which bind immunogen. Adjuvants which saturate Kupffer cells Carbohydrate adjuvants which target lectin receptors on macrophages and DCs | Efficient use of adjuvant and immunogen As above. May also determine type of response if targeting selective |
| 5. Depot Generation | w/o emulsion for short term Microspheres or nanospheres for long term | Efficiency Potential for single-dose vaccine |

Source: Cox, J. C., and Coulter, A. R. (1997). Vaccine 15, 248-56.

A vaccine composition according to the present invention may comprise more than one different adjuvant. Furthermore, the invention encompasses a therapeutic composition further comprising any adjuvant substance including any of the above or combinations thereof. It is also contemplated that one or more of the pharmamers according to the present invention, and the adjuvant can be administered separately in any appropriate sequence.

In one embodiment the present invention relates to a vaccine composition comprising more than 1 vaccine adjuvant, such as more than 2, 3, 4, 5, 6, 7, 8, 9, 10, 11, 12, 13, 14, 15, 16, 17, 18, 19, 20, 25, 30, 35, 40, 45, 50, 55, 60, 65, 70, 75, 80, 85, 90, 95, 100, 200, 300, 400, 500, 600, 700, 800, 900, 1,000, 2,000, 3,000, 4,000, 5,000, 6,000, 7,000, 8,000, 9,000, or more than 10,000 vaccine adjuvants.

In another embodiment the present invention relates to a vaccine composition comprising more than 1 different vaccine adjuvant, such as more than 2, 3, 4, 5, 6, 7, 8, 9, 10, 11, 12, 13, 14, 15, 16, 17, 18, 19, 20, 25, 30, 35, 40, 45, 50, 55, 60, 65, 70, 75, 80, 85, 90, 95, 100, 200, 300, 400, 500, 600, 700, 800, 900, 1,000, 2,000, 3,000, 4,000, 5,000, 6,000, 7,000, 8,000, 9,000, or more than 10,000 different vaccine adjuvants.

In yet another embodiment the present invention relates to a vaccine composition comprising more than 1 identical vaccine adjuvant, such as more than 2, 3, 4, 5, 6, 7, 8, 9, 10, 11, 12, 13, 14, 15, 16, 17, 18, 19, 20, 25, 30, 35, 40, 45, 50, 55, 60, 65, 70, 75, 80, 85, 90, 95, 100, 200, 300, 400, 500, 600, 700, 800, 900, 1,000, 2,000, 3,000, 4,000, 5,000, 6,000, 7,000, 8,000, 9,000, or more than 10,000 identical vaccine adjuvants.

In one embodiment the present invention relates to a vaccine composition comprising less than 10,000 vaccine adjuvants, such as for example less than 9,000, 8,000, 7,000, 6,000, 5,000, 4,000, 3,000, 2,000, 1,000, 900, 800, 700, 600, 500, 400, 300, 200, 100, 95, 90, 85, 80, 75, 70, 65, 60, 55, 50, 45, 40, 35, 30, 25, 20, 15, 10, 9, 8, 7, 6, 5, 4, 3, or less than 2 vaccine adjuvants.

In one embodiment the present invention relates to a vaccine composition comprising less than 10,000 different vaccine adjuvants, such as for example less than 9,000, 8,000, 7,000, 6,000, 5,000, 4,000, 3,000, 2,000, 1,000, 900, 800, 700, 600, 500, 400, 300, 200, 100, 95, 90, 85, 80, 75, 70, 65, 60, 55, 50, 45, 40, 35, 30, 25, 20, 15, 10, 9, 8, 7, 6, 5, 4, 3, or less than 2 different vaccine adjuvants.

In one embodiment the present invention relates to a vaccine composition comprising less than 10,000 identical vaccine adjuvants, such as for example less than 9,000, 8,000, 7,000, 6,000, 5,000, 4,000, 3,000, 2,000, 1,000, 900, 800, 700, 600, 500, 400, 300, 200, 100, 95, 90, 85, 80, 75, 70, 65, 60, 55, 50, 45, 40, 35, 30, 25, 20, 15, 10, 9, 8, 7, 6, 5, 4, 3, or less than 2 identical vaccine adjuvants.

Vaccine Enhancers

A vaccine enhancer may be present in the pharmamer vaccine independently of an adjuvant. The function of a vaccine enhancer can for example be to increase the molecular weight of the pharmamer in order to increase their activity or immunogenicity, to confer stability, to increase the biological activity, or to increase serum half-life. Furthermore, a vaccine enhancer may aid presenting the pharmamer to T-cells. The vaccine enhancer may be any suitable vaccine enhancer known to the person skilled in the art, for example a protein or an antigen presenting cell. A vaccine enhancer protein could be but is not limited to keyhole limpet hemocyanin, serum proteins such as transferrin, bovine serum albumin, human serum albumin, thyroglobulin or ovalbumin, immunoglobulins, or hormones, such as insulin or palmitic acid. For immunization of humans, the vaccine enhancer must be a physiologically acceptable vaccine enhancer acceptable to humans and safe. However, tetanus toxoid and/or diptheria toxoid are suitable vaccine enhancers in one embodiment of the invention. Alternatively, the vaccine enhancer may be dextrans for example sepharose.

In one embodiment, the vaccine composition may comprise dendritic cells. The dendritic cells (DC) may be prepared and used in therapeutic procedure according to any suitable protocol.

Combination with Other Vaccines/1 Vaccine Components

In another embodiment of the present invention the composition of a pharmamer vaccine may be also comprise one or more other type of vaccines or vaccine components different from pharmamers, i.e. such a composition may have a pharmamer vaccine component and one or more other vaccine components. Such other vaccine components may be categorized depending on several characteristics, including way of action; being prophylactic or therapeutic i.e. whether the vaccine induce complete prevention from disease; or improvement of disease or relief from disease symptoms; way of administration; times of administration; what kind of physical feature or matter is administered; what specific physical feature or matter is treated and how is this feature or matter treated.

Other vaccine components of the present invention include:

A vaccine is an antigenic preparation used to establish immunity to a disease or illness and thereby protects or cures the body from a specific disease or illness. Vaccines are either prophylactic and prevent disease or therapeutic and treat disease. Vaccines may contain more than one type of antigen and is then called a combined vaccine.

Example, prophylactic vaccines are conventional vaccines for infectious diseases, such as measles, mumps, and tetanus. These vaccines are effective because they expose the immune system to weakened versions of the disease. This exposure causes the immune system to respond by producing antibodies. Once the immune system has created antibodies, some of the activated immune cells remember the exposure. Therefore, the next time the same antigen enters the body, the immune system can respond more readily to destroy it.

For cancer treatment, researchers are developing vaccines that can encourage the immune system to recognize cancer cells. These vaccines can help the body reject tumors and prevent cancer from recurring. In contrast to traditional vaccines against infectious diseases, cancer vaccines are designed to be injected after the disease is diagnosed, rather than before it develops and are therefore therapeutic. By example, it has been shown that immunization with dendritic cells (DC) loaded with appropriate peptides from tumor associated antigens (TAAs) stimulate "tumor specific" T-cells, which in some patients prevent further progression of the disease and eventually lead to regression of the disease.

In the present invention other vaccines/other vaccine components are subdivided into the following categories:

Vaccines Made of Living Virulent Microorganisms.

Virulence refers to the degree of pathogenecity of a microbe, or in other words the relative ability of a microbe to cause disease. Examples of such organisms include but is not limited to bacteria, virus, parasites or other pathogens. Most pathogens will not be useful for vaccines if they are fully virulent but certain natural occurring modest virulent strains can be used. The vaccine may result in protection against the organism used for vaccination but may also induce protections against related virulent organisms The organism may be fully virulent
The organism may be partly virulent meaning that the virulence of the organism has been reduced. Such organisms are often called live attenuated microorganisms. Attenuated means reducing the virulence of the microorganism while keeping it viable. Examples of reducing the virulence og an microorganism includes but is not limited to
- Modifying the microorganism by physical means, e.g. by heating
- Modifying the microorganism by chemical means, e.g. by addition of chemicals to the microorganism.
- Genetically modified microorganisms, e.g. recombinant bacteria or virus missing virulence factors
- Cultured under conditions that disable their virulent properties One way to reduce the virulence of an organism is passage through a foreign host e.g. tissue cultures, embryo eggs or live animals.

Killed microorganisms are another type of vaccine. Microorganisms can be killed in several ways including but not limited to
- Physically killing
  - Killing by heating
  - Killing by radioactive irradiation
- Chemically killing, e.g. by treatment with phenol, formaldehyde or other chemicals able to kill microorganism.

Subunit/fragment(s) of microorganism can be used as vaccine. The fragments may be isolated directly from microorganism or produced using recombinant DNA technology. Fragments/subunits of microorganisms useful in vaccines of the present invention includes but is not limited to
- Macromolecules, e.g. naturally occurring or artificial made. Macromolecules of the present invention includes but is not limited to:
  - Proteins. The proteins may be full length or truncated and may be modified e.g. by introduction of additional amino acids, mutated, chemically modified (e.g. acetylation, methylation, Pegylation, phosphorylation, glycosylation ect.) or carrying other modifications e.g. converted into lipoprotein by the N-terminal addition of Ns-palmytoyl-lysine. The proteins may also be stabilized by covalent or non-covalent attachment of protein linkers or other protein molecules. Proteins of the present invention includes but is not limited to:
    - Proteins of the immune system
      - Cytokines
      - Interleukins (cytokines produces by leukocytes)
      - Interferon's (cytokines that can induce cells to resist viral replication)
      - Chemokines or their receptors
      - Antibodies (monoclonal, polyclonal,
      - Full length
      - Fab fragments
      - scFv fragments
      - antibody-like (scaffolds)
      - MHC molecules.
      - MHC I molecules
      - MHC I molecules consisting of full length or truncated heavy chain, full length or truncated β2m and peptide
      - MHC I molecule consisting of full length or truncated heavy chain and full length and truncated β2m but no peptide (empty MHC I molecule)
      - MHC I molecule consisting of full length or truncated heavy chain and peptide
      - MHC I molecule consisting of full length or truncated heavy chain
      - MHC II molecules
      - MHC II molecules consisting of full length or truncated alpha chain and full length or truncated beta chain and peptide
      - MHC II molecules consisting of full length or truncated alpha chain and full length and truncated beta chain but no peptide (empty MHC II molecule)
    - Peptides
      - Antigenic peptides, meaning any peptide that is bound or able to bind MHC molecules.
      - With binding motif for MHC I
      - With binding motif for MHC II
      - Other peptides
    - Heat shock proteins e.g. HSP70 and HSP90
    - T cell receptor (TCR)
      - Full length
      - Truncated
      - Stabilized by e.g. a peptidelinker
    - Proteins from microorganisms
      - Surface proteins
      - Intracellular proteins
      - Secreted proteins (e.g. toxins)
      - Unmodified
      - Modified (e.g. toxoid)
      - Chemically modified
      - Physically modified
  - Nucleic acids
    - DNA
      - Encoding protein
      - Structural not encoding protein
    - RNA
      - Ribosome's
      - Antisense
      - Silencing RNA
      - Micro RNA
    - LNA
    - PNA
  - Carbohydrates
    - Saccharides and derivatives thereof, e.g. phosphorylated, oxidized, reduced, amino derivatives, acetylated ect. Saccharides may have more than one modification
      - Monosaccharide's
      - Disaccharides
      - Polysaccharides
      - Homopolysaccharides (e.g. glycans, dextran)
      - Polymers of repeating disaccharide units in which one of the sugars are is either N-acetylgalactosamine or N-acetylglucosamine (e.g. Glucosaminoglycans)
      - Polysaccharide-peptide polymer (Peptidoglycan (bacterial cell wall))
  - Proteins carrying covalent attached oligosaccharides or polysaccharides (Glycoprotein's)
  - Lipids carrying covalent attached oligo- or polysaccharides (Glycolipids)
- All macromolecules may be individual or in complex (e.g. attached to polymer backbone, solid support e.g. beads or other solid support, microspheres, liposome's or other nanoclusters)

Cell based vaccine is another type of vaccine of the present invention. Characteristics of different cell based vaccines are listed below.

Consisting of naturally occurring cells

Cells are isolated and optionally amplified e.g. by proliferation

Cells are isolated and modified to display specific molecules e.g. specific MHC complexes by incubation with antigenic peptide. Following modification the cells may be proliferated.

Consisting of non-naturally occurring cells. Non-naturally occurring cells of the present invention includes but is not limited to:

Chemically modified cells

Genetically modified cells

Cells fused to another cell (e.g. hybridomas)

Cells transfected, transformed or transduced with genes or nucleic acids encoding specific proteins (e.g. with super coiled plasmid DNA linear DNA, RNA, siRNA or other)

Examples of Pharmamer Vaccines

A pharmamer vaccine can be designed to elicit a multifunctional immune response i.e. a composite immune responses directed against both arms of the immune system being the adaptive and the innate immune system; and both parts of the adaptive system i.e. the humoral and the cellular part.

Example, a pharmamer vaccine against HIV (Human Immunodeficiency virus) can be designed to elicit a multifunctional immune response by combining two or more of the following components:

HLA class 1 and class 2 molecules (Human major histocompatibility antigens) for stimulation of an allo-response i.e. a response against foreign HLA. The HLA class 1 molecules are folded or partly folded with human b2Microglobulin and a peptide fitting into the binding groove. The HLA class 1 heavy chain can be complete, partial or otherwise modified. The HLA class 2 molecules consist of folded or partly folded alpha- and beta-chains with or without a peptide in the binding groove. The HLA class 2 alpha- and beta-chains can be complete, partial or otherwise modified. The peptides bound in the binding grooves may be chosen among binding-peptides derived from HIV specific proteins, i.e. Gag-Pol, Pr55(Gag), Vif, Vpr, Tat, Rev, Vpu, Nef, gp160 and derivatives such as gp120, gp41 and gp140, or they may be HIV unrelated. HIV virus carries the former host's HLA class 1 and 2 in the viral membrane. The HLA molecules elicit allo-responses directed against the foreign HLA molecules and recently it has been shown that allo-responses upregulate the intracellular anti HIV-1 factor (APOBEC3G) shown to play a crucial part in protection against HIV infection;

HLA class 1 peptides derived from regions of the class 1 heavy chain;

HLA class 2 peptides derived from regions of the class 2 alpha and/or beta chain;

CD4 or part(s) hereof, the major receptor for HIV virus entry;

CCR 5 (Chemokine Receptor 5) or part(s) hereof. CCR5 is an important co-receptor for HIV virus entry into the host cell. In addition the extracellular peptide-loops of CCR5 are known to inhibit strains of HIV and SIV and act synergistically with HSP70 to stimulate the innate immune responses;

CXCR4 or part(s) hereof. CXCR4 can function as co-receptor for HIV virus entry into the host cell;

CCR 2 (Chemokine Receptor 2) or part(s) hereof. CCR2 can function as co-receptor for HIV virus entry into the host cell;

CX3CR1 or part(s) hereof. CX3CR1 can function as co-receptor for HIV virus entry into the host cell;

SDF-1 or part(s) hereof. SDF-1 can function as co-receptor for HIV virus entry into the host cell;

US28 or part(s) hereof. US28 is a CMV (Cytomegalovirus) protein expressed on already CMV infected cells that can function as co-receptor for HIV virus entry into the host cell;

HIV viral specific proteins i.e. Gag-Pol, Pr55(Gag), Vif, Vpr, Tat, Rev, Vpu, Nef, gp160 and derivatives such as but not limited to gp120, gp41 and gp140;

HSP70 (70 kD Heat-shock protein) or part(s) hereof. HSP70 induces a robust mucosal immune response. HSP70 in addition generates a number of anti-HIV functions, such as inducing production of the CCR5 binding CC chemokines, blocking CCR5 directly, and stimulating DC (Dendritic Cells) to produce IL-15 which inhibits HIV-1 and enhances the inhibitory effect of CD8-SF (CD8 Suppressor Factor). HSP70 enhances memory T cells, upregulates the costimulatory CD40-CD40L pathway and induces cross-presentations of antigens. An important feature is that HSP70 upregulate the intracellular anti HIV-1 factor, APOBEC3G (apolipoprotein B mRNA-editing, enzyme-catalytic, polypeptide-like-3G) which has recently been shown to play a crucial role in protection against HIV infection The pharmamer HIV vaccine can be applied at the cervico-vaginal mucosa i.e. vaginally or IM i.e. intra-muscular. The pharmamer HIV vaccine can be administered alone or together with additional adjuvant(s) such as but not limited to Titermax Gold, Alhydrogel (Aluminium-hydroxide), MF59 and the proprietary Montanide ISA720.

Example, a pharmamer vaccine against SIV (Simian Immunodeficiency virus) can be designed to elicit a multifunctional immune response by combining two or more of the following components:

Simian Mamu class 1 and/or class 2 molecules (Mokey major histocompatibility antigens) for stimulation of an allo-response i.e. a response against foreign Mamu. The Mamu class 1 molecules are folded or partly folded with human b2Microglobulin and a peptide fitting into the binding groove. The Mamu class 1 heavy chain can be complete, partial or otherwise modified. The Mamu class 2 molecules consist of folded or partly folded alpha- and beta-chains with or without a peptide in the binding groove. The Mamu class 2 alpha- and beta-chains can be complete, partial or otherwise modified. The peptides bound in the binding grooves may be chosen among binding-peptides derived from SIV specific proteins, i.e. Gag-Pol, Gag, Vif, Vpx, Envelope protein, Nef, or they may be SIV unrelated. HIV virus carries the former host's Mamu class 1 and 2 in the viral membrane. The Mamu molecules elicit allo-responses directed against the foreign Mamu molecules and recently it has been shown that allo-responses upregulate the intracellular anti HIV-1 factor (APOBEC3G) shown to play a crucial part in protection against HIV infection;

Mamu class 1 peptides derived from regions of the class 1 heavy chain;

Mamu class 2 peptides derived from regions of the class 2 alpha and/or beta chain;

CD4 or part(s) hereof, the major receptor for SIV virus entry;

CCR 5 (Chemokine Receptor 5) or part(s) hereof. CCR5 is an important co-receptor for SIV virus entry into the host cell. In addition the extracellular peptide-loops of CCR5 are known to inhibit strains of HIV and SIV and act synergistically with HSP70 to stimulate the innate immune responses;

CXCR4 or part(s) hereof. CXCR4 can function as co-receptor for SIV virus entry into the host cell;

CCR 2 (Chemokine Receptor 2) or part(s) hereof. CCR2 can function as co-receptor for SIV virus entry into the host cell;

CX3CR1 or part(s) hereof. CX3CR1 can function as co-receptor for SIV virus entry into the host cell;

SDF-1 or part(s) hereof. SDF-1 can function as co-receptor for SIV virus entry into the host cell;

SIV viral specific proteins i.e. Gag-Pol, Gag, Vif, Vpx, Envelope protein, Nef; HSP70 (70 kD Heat-shock protein) or part(s) hereof. HSP70 induces a robust mucosal immune response. HSP70 in addition generates a number of anti-SIV functions, such as inducing production of the CCR5 binding CC chemokines, blocking CCR5 directly, and stimulating DC (Dendritic Cells) to produce IL-15 which inhibits HIV-1 and enhances the inhibitory effect of CD8-SF (CD8 Suppressor Factor). HSP70 enhances memory T cells, upregulates the costimulatory CD40-CD40L pathway and induces cross-presentations of antigens. An important feature is that HSP70 upregulate the intracellular anti SIV factor, APOBEC3G (apolipoprotein B mRNA-editing, enzyme-catalytic, polypeptide-like-3G) which has recently been shown to play a crucial role in protection against SIV infection The pharmamer HIV vaccine can be applied at the cervico-vaginal mucosa i.e. vaginally or IM i.e. intra-muscular. The pharmamer HIV vaccine can be administered alone or together with additional adjuvant(s) such as but not limited to Titermax Gold, Alhydrogel (Aluminium-hydroxide), MF59 and the proprietary Montanide ISA720.

Combination Therapy

The present invention furthermore relates to pharmaceutical compositions and kit-of-parts for use in combination therapy.

Combination therapy as used herein denotes treatment an individual in need thereof with more than one different method. Hence combination therapy may in one aspect involve administration of a pharmaceutical composition or a kit of parts comprising a vaccine composition as described herein above and e.g. an anti-cancer or anti-HIV medicament.

Anti-cancer medicaments may be any of the medicaments described herein below, for example a chemotherapeutic agent or a immunotherapeutic agent.

In particular combination therapy may involve administration to an individual of a chemotherapeutic agent and/or an immunotherapeutic agent in combination with one or more of i) the pharmamer of the present invention, ii) an antigen presenting cell presenting the pharmamer of the present invention, and iii) an activated, pharmamer specific T-cell. However, combination therapy may also involve radiation therapy, gene therapy and/or surgery.

Combination therapy thus may include administration, simultaneously, or sequentially in any order, of e.g.:

i) the pharmamer of the present invention+at least one chemotherapeutic agent ii) the pharmamer of the present invention+at least one immunotherapeutic agent iii) Antigen presenting cell presenting the pharmamer of the present invention+at least one chemotherapeutic agent iv) Antigen presenting cell presenting the pharmamer of the present invention+at least one immunotherapeutic agent v) Activated T-cells+at least one chemotherapeutic agent vi) Activated T-cells+at least one immunotherapeutic agent Further combinations include i) and ii); iii) and iv); v) and vi); i) and iii); i) and iv), i) and v); i) and vi); ii) and iii); ii) and iv); ii) and v); ii) and vi); iii) and v); iii) and vi); iv) and v); iv) and vi); i) and iv) and any of v) and vi).

The chemotherapeutic agent can be e.g. methotrexate, vincristine, adriamycin, cisplatin, non-sugar containing chloroethylnitrosoureas, 5-fluorouracil, mitomycin C, bleomycin, doxorubicin, dacarbazine, taxol, fragyline, Meglamine GLA, valrubicin, carmustaine and poliferposan, MM1270, BAY 12-9566, RAS famesyl transferase inhibitor, famesyl transferase inhibitor, MMP, MTA/LY231514, LY264618/Lometexol, Glamolec, CI-994, TNP-470, Hycamtin/Topotecan, PKC412, Valspodar/PSC833, Novantrone/Mitroxantrone, Metaret/Suramin, Batimastat, E7070, BCH-4556, CS-682, 9-AC, AG3340, AG3433, Incel/VX-710, VX-853, ZD0101, ISI641, ODN 698, TA 2516/Marmistat, BB2516/Marmistat, CDP 845, D2163, PD183805, DX8951f, Lemonal DP 2202, FK 317, Picibanil/OK-432, AD 32/Valrubicin, Metastron/strontium derivative, Temodal/Temozolomide, Evacet/liposomal doxorubicin, Yewtaxan/Placlitaxel, Taxol/Paclitaxel, Xeload/Capecitabine, Furtulon/Doxifluridine, Cyclopax/oral paclitaxel, Oral Taxoid, SPU-077/Cisplatin, HMR 1275/Flavopiridol, CP-358 (774)/EGFR, CP-609 (754)/RAS oncogene inhibitor, BMS-182751/oral platinum, UFT (Tegafur/Uracil), Ergamisol/Levamisole, Eniluracil/776C85/5FU enhancer, Campto/Levamisole, Camptosar/lrinotecan, Tumodex/Ralitrexed, Leustatin/Cladribine, Paxex/Paclitaxel, Doxil/liposomal doxorubicin, Caelyx/liposomal doxorubicin, Fludara/Fludarabine, Pharmarubicin/Epirubicin, DepoCyt, ZD1839, LU 79553/Bis-Naphtalimide, LU 103793/Dolastain, Caetyx/lliposomal doxorubicin, Gemzar/Gemcitabine, ZD 0473/Anormed, YM 116, Iodine seeds, CDK4 and CDK2 inhibitors, PARP inhibitors, D4809/Dexifosamide, Ifes/Mesnex/Ifosamide, Vumon/Teniposide, Paraplatin/Carboplatin, Plantinol/cisplatin, Vepeside/Etoposide, ZD 9331, Taxotere/Docetaxel, prodrug of guanine arabinoside, Taxane Analog, nitrosoureas, alkylating agents such as melphelan and cyclophosphamide, Aminoglutethimide, Asparaginase, Busulfan, Carboplatin, Chlorombucil, Cytarabine HCl, Dactinomycin, Daunorubicin HCl, Estramustine phosphate sodium, Etoposide (VP16-213), Floxuridine, Fluorouracil (5-FU), Flutamide, Hydroxyurea (hydroxycarbamide), Ifosfamide, Interferon Alfa-2a, Alfa-2b, Leuprolide acetate (LHRH-releasing factor analogue), Lomustine (CCNU), Mechlorethamine HCl (nitrogen mustard), Mercaptopurine, Mesna, Mitotane (o.p'-DDD), Mitoxantrone HCl, Octreotide, Plicamycin, Procarbazine HCl, Streptozocin, Tamoxifen citrate, Thioguanine, Thiotepa, Vinblastine sulfate, Amsacrine (m-AMSA), Azacitidine, Erthropoietin, Hexamethylmelamine (HMM), Interleukin 2, Mitoguazone (methyl-GAG; methyl glyoxal bis-guanylhydrazone; MGBG), Pentostatin (2'deoxycoformycin), Semustine (methyl-CCNU), Teniposide (VM-26) and Vindesine sulfate. Furthermore, the chemotheraputic agent may be any of the chemotherapeutic agents mentioned in table 3 of U.S. Pat. No. 6,482,843 column 13 to 18.

The anti-cancer drug can in one preferred embodiment be selected from the group consisting of Aldesleukin/Proleukin (Chiron Corp), Alemtuzumab/Campath (Millennium and ILEX Partners, LP), alitretinoin/Panretin (Ligand Pharmaceuticals), allopurinol/Zyloprim (GlaxoSmithKline), altretamine/Hexalen (US Bioscience), amifostine/Ethyol (US Bioscience), anastrozole/Arimidex (AstraZeneca), arsenic trioxide/Trisenox (Cell Therapeutic), Asparaginase/Elspar (Merck & Co, Inc), BCG Live/TICE BCG (Organon Teknika Corp), bexarotene capsules/Targretin (Ligand Pharmaceuticals), bleomycin/Blenoxane (Bristol-Myers Squibb), busulfan/Busulfex (GlaxoSmithKline), calusterone/Methosarb (Pharmacia & Upjohn Company), capecitabine/Xeloda (Roche), carboplatin/Paraplatin (Bristol-Myers Squibb), carmustine/BCNU, BiCNU (Bristol-Myers Squibb), carmustine with Polifeprosan 20 Implant/Gliadel Wafer (Guilford Pharmaceuticals Inc.), celecoxib/Celebrex (Searle), chlorambucil/Leukeran (GlaxoSmithKline), cisplatin/Platinol (Bristol-Myers Squibb), cladribine/Leustatin, 2-CdA (R.W. Johnson Pharmaceutical Research Institute), cyclophosphamide Cytoxan/Neosar (Bristol-Myers Squibb), cytarabine/Cytosar-U (Pharmacia & Upjohn Company), dacarbazine/DTIC-Dome (Bayer), dactinomycin/actinomycin D Cosmegen (Merck), Darbepoetin alfa/Aranesp (Amgen, Inc), daunorubicin/daunomycin/Daunorubicin (Bedford Labs), daunorubicin/daunomycin/Cerubidine (Wyeth Ayerst), Denileukin/diftitox/Ontak (Seragen, Inc), dexrazoxane/Zinecard (Pharmacia & Upjohn Company), docetaxel/Taxotere (Aventis Pharmaceutical), doxorubicin Adriamycin/Rubex (Pharmacia & Upjohn Company), DROMOSTANOLONE PROPIONATE/MASTERONE INJECTION (SYNTEX), Elliott's B Solution (Orphan Medical, Inc), epirubicin/Ellence (Pharmacia & Upjohn Company), etoposide phosphate (Bristol-Myers Squibb), etoposide/VP-16/Vepesid (Bristol-Myers Squibb), exemestane/Aromasin (Pharmacia & Upjohn Company), Filgrastim/Neupogen (Amgen, Inc), floxuridine/FUDR (Roche), fludarabine/Fludara (Berlex Laboratories Inc.), fluorouracil/5-FU/Adrucil (ICN Puerto Rico), fulvestrant/Faslodex (IPR), gemcitabine/Gemzar (Eli Lilly), gemtuzumab/ozogamicin/Mylotarg (Wyeth Ayerst), goserelin acetate/Zoladex Implant (AstraZeneca Pharmaceuticals), hydroxyurea/Hydrea (Bristol-Myers Squibb), Ibritumomab Tiuxetan/Zevalin (IDEC Pharmaceuticals Corp), idarubicin/Idamycin (Adria Laboratories), ifosfamide/IFEX (Bristol-Myers Squibb), imatinib mesylate/Gleevec (Novartis), Interferon alfa-2a/Roferon-A (Hoffmann-La Roche Inc), Interferon alfa-2b/Intron A (Schering Corp), irinotecan/Camptosar (Pharmacia & Upjohn Company), letrozole/Femara (Novartis), leucovorin Wellcovorin/Leucovorin (Immunex Corporation), levamisole/Ergamisol (Janssen Research Foundation), lomustine/CCNU/CeeBU (Bristol-Myers Squibb), meclorethamine/nitrogen mustard/Mustargen (Merck), megestrol acetate/Megace (Bristol-Myers Squibb), melphalan/L-PAM/Alkeran (GlaxoSmithKline), mercaptopurine/6-MP Purinethol (GlaxoSmithKline), mesna/Mesnex (Asta Medica), methotrexate (Lederle Laboratories), methoxsalen/Uvadex (Therakos), mitomycin C/Mutamycin (Bristol-Myers Squibb), mitomycin C/Mitozytrex (Supergen), mitotane/Lysodren (Bristol-Myers Squibb), mitoxantrone/Novantrone (Lederle Laboratories), nandrolone phenpropionate/Durabolin-50 (Organon), Nofetumomab/Verluma (Boehringer Ingelheim Pharma KG (formerly Dr. Karl Thomae GmbH)), Oprelvekin/Neumega (Genetics Institute), oxaliplatin/Eloxatin (Sanofi Synthelabo), paclitaxel/Taxol (Bristol-Myers Squibb), pamidronate/Aredia (Novartis), pegademase/Adagen (Pegademase Bovine) (Enzon), Pegaspargase/Oncaspar (Enzon, Inc), Pegfilgrastim/Neulasta (Amgen, Inc), pentostatin/Nipent (Parke-Davis Pharmaceutical Co.), pipobroman/Vercyte (Abbott Labs), plicamycin/mithramycin/Mithracin (Pfizer Labs), porfimer sodium/Photofrin (QLT Phototherapeutics Inc.), procarbazine/Matulane (Sigma Tau Pharms), quinacrine/Atabrine (Abbott Labs), Rasburicase/Elitek (Sanofi-Synthelabo, Inc), Rituximab/Rituxan (Genentech, Inc), Sargramostim/Prokine (Immunex Corp), streptozocin/Zanosar (Pharmacia & Upjohn Company), talc/Sclerosol (Bryan), tamoxifen/Nolvadex (AstraZeneca Pharmaceuticals), temozolomide/Temodar (Schering), teniposide/VM-26/Vumon (Bristol-Myers Squibb), testolactone/Teslac (Bristol-Myers Squibb), thioguanine/6-TG/Thioguanine (GlaxoSmithKline), thiotepa/Thioplex (Lederle Laboratories), topotecan/Hycamtin (GlaxoSmithKline), topotecan/Hycamtin (GlaxoSmithKline), toremifene/Fareston (Orion Corp), Tositumomab/Bexxar (Corixa Corporation), Trastuzumab/Herceptin (Genentech, Inc), tretinoin/ATRA/Vesanoid (Roche), Uracil Mustard (Roberts Labs), valrubicin/Valstar (Medeva), vinblastine/Velban (Eli Lilly), vincristine/Oncovin (Eli Lilly), vinorelbine/Navelbine (GlaxoSmithKline), and zoledronate/Zometa (Novartis).

The immunotherapeutic agent can be e.g. Ributaxin, Herceptin, Quadramet, Panorex, IDEC-Y2B8, BEC2, C225, Oncolym, SMART MI 95, ATRAGEN, Ovarex, Bexxar, LDP-03, ior t6, MDX-210, MDX-11, MDX-22, OV103, 3622W94, anti-VEGF, Zenapax, MDX-220, MDX-447, MELIMMUNE-2, MELIMMUNE-1, CEACIDE, Pretarget, NovoMAb-G2, TNT, Gliomab-H, GNI-250, EMD-72000, LymphoCide, CMA 676, Monopharm-C, 4B5, ior egf.r3, ior c5, BABS, anti-FLK-2, MDX-260, ANA Ab, SMART 1D10 Ab, SMART ABL 364 Ab and ImmuRAIT-CEA. Furthermore the immunotherapeutic agent may be any cytokine or interferon.

The therapeutic compositions or vaccine compositions of the invention can also be used in combination with other anti-cancer strategies, and such combination therapies are effective in inhibiting and/or eliminating tumor growth and metastasis. The methods of the present invention can advantageously be used with other treatment modalities, including, without limitation, radiation, surgery, gene therapy and chemotherapy.

The therapeutic compositions or vaccine compositions of the invention can also be used in combination with treatment of HIV. In one embodiment treatment of HIV includes administration of one or more of the drugs listed herein below.

There are five groups of antiretroviral drugs. Each of these groups attacks HIV in a different way.

| Antiretroviral drug class | Abbreviations | How they attack HIV |
| --- | --- | --- |
| Nucleoside/Nucleotide Reverse Transcriptase Inhibitors | NRTIs, nucleoside analogues, nukes | NRTIs interfere with the action of an HIV protein called reverse transcriptase, which the virus needs to make new copies of itself. |
| Non-Nucleoside Reverse Transcriptase Inhibitors | NNRTIs, non-nucleosides, non-nukes | NNRTIs also stop HIV from replicating within cells by inhibiting the reverse transcriptase protein. |
| Protease Inhibitors | PIs | PIs inhibit protease, which is another protein involved in the HIV replication process. |

-continued

| Antiretroviral drug class | Abbreviations | How they attack HIV |
|---|---|---|
| Fusion or Entry Inhibitors | | Fusion or entry inhibitors prevent HIV from binding to or entering human immune cells. |
| Integrase Inhibitors | | Integrase inhibitors interfere with the integrase enzyme, which HIV needs to insert its genetic material into human cells. |

Multi-Class Combinations:

| Combination | Brand name |
|---|---|
| Efavirenz + TDF + FTC | Atripla |
| d4T + 3TC + NVP | — |
| AZT + 3TC + NVP | — |

Nucleoside/Nucleotide Reverse Transcriptase Inhibitors (NRTIs):

| Abbreviation | Generic name | Brand name |
|---|---|---|
| 3TC | lamivudine | Epivir |
| ABC | abacavir | Ziagen |
| AZT or ZDV | Zidovudine | Retrovir |
| d4T | Stavudine | Zerit |
| ddC | Zalcitabine | Hivid |
| ddI | didanosine | Videx (tablet) Videx EC (capsule) |
| FTC | emtricitabine | Emtriva |
| TDF | tenofovir | Viread |

Combined NRTIs:

| Combination | Brand name |
|---|---|
| ABC + 3TC | Epzicom (US) Kivexa (Europe) |
| ABC + AZT + 3TC | Trizivir |
| AZT + 3TC | Combivir |
| TDF + FTC | Truvada |
| d4T + 3TC | — |

Non-Nucleoside Reverse Transcriptase Inhibitors (NNRTIs):

| Abbreviation | Generic name | Brand name |
|---|---|---|
| DLV | Delavirdine | Rescriptor |
| EFV | Efavirenz | Sustiva (US) Stocrin (Europe) |
| ETR | Etravirine | Intelence |
| NVP | Nevirapine | Viramune |

Protease Inhibitors (PIs):

| Abbreviation | Generic name | Brand name |
|---|---|---|
| APV | amprenavir | Agenerase |
| FOS-APV | fosamprenavir | Lexiva (US) Telzir (Europe) |
| ATV | Atazanavir | Reyataz |
| DRV | Darunavir | Prezista |
| IDV | Indinavir | Crixivan |
| LPV/RTV | lopinavir + ritonavir | Kaletra Aluvia (developing world) |
| NFV | nelfinavir | Viracept |
| RTV | ritonavir | Norvir |
| SQV | saquinavir | Fortovase (soft gel capsule) Invirase (hard gel capsule) |
| TPV | Tipranavir | Aptivus |

Fusion or Entry Inhibitors:

| Abbreviation | Generic name | Brand Name |
|---|---|---|
| T-20 | Enfuvirtide | Fuzeon |
| MVC | maraviroc | Celsentri (Europe) Selzentry (US) |

Integrase Inhibitors:

| Abbreviation | Generic name | Brand Name |
|---|---|---|
| RAL | raltegravir | Isentress |

Other types of HIV treatments include administration of one or more of the following:

Atripla—(a single pill that includes efavirenz+tenofovir+FTC). People taking a first-line combination of efavirenz and Truvada, with an undetectable viral load for three months, can switch to Atripla Atazanavir/r for first-line therapy is currently being researched, and the results are expected shortly. Atavanavir/r is widely used as first line treatment.

Darunavir/r was approved as a treatment for people with resistance. In a recent study, darunavir did better than Kaletra as first therapy.

Raltegravir—(an integrase inhibitor) has shown similar potency to efavirenz, but has fewer side effects or interactions with other drugs.

Maraviroc—(an entry inhibitor).

Etravirine—(a new NNRTI).

"Combination therapy" can include the introduction of heterologous nucleic acids into suitable cells, generally known as gene therapy. For example gene therapy may involve introduction of tumour suppressor genes or apoptosis promoting genes into tumour cells. Alternatively, nucleic acid sequences inhibiting expression of oncogenes or apoptosis inhibiting genes may be introduced to tumour cells. Furthermore, genes that encode enzymes capable of conferring to tumor cells sensitivity to chemotherapeutic agents may be introduced. Accordingly, the present invention in one embodiment provides a method comprising the step of treating cancer by introducing a gene vector, encoding a protein capable of enzymatically converting a prodrug, i.e., a non-toxic compound, into a toxic compound. In the method of the present invention, the therapeutic nucleic acid sequence is a nucleic acid coding for a product, wherein the product causes cell death by itself or in the presence of other drugs. A representative example of such a therapeutic nucleic acid is one, which codes for thymidine kinase of herpes simplex virus. Additional examples are thymidine kinase of varicella zoster virus and the bacterial gene cytosine deaminase, which can convert 5-fluorocytosine to the highly toxic compound 5-fluorouracil.

Kit-of-Parts

A kit comprising a composition of the present invention is also provided. The kit can include a separate container containing a suitable vaccine enhancer, diluent or excipient, In addition, the kit can include instructions for mixing or combining ingredients and/or administration route/shemes.

Detection of Vaccine Results

In one embodiment the present invention relates to use of the pharmamers according to the present invention such as MHC dextramers for use of detection of vaccine results. Dectection of the vaccine response can comprise any method for immune monitoring know in the art including one or more assays described in PCT/DK/2008/050168, PCT/DK2008/050167 and PA 2008 01035. PCT/DK/2008/050168, PCT/DK2008/050167 and PA 2008 01035 are hereby incorporated by reference in there entirety in this application.

In one embodiment a blood sample such as peripheral blood is obtained from a patient before vaccination and subsequent to a series of vaccinations. In order to identify peptide-specific T-cell precursors, periferal blood lymphocytes (PBL) are used e.g. directly in ELISPOT (designated direct ELISPOT) or any other relevant assay know in the art such as ELISA.

In one aspect the invention relates to methods of monitoring immunisation, said method comprising the steps of
  i) providing a blood sample from an individual
  ii) providing a peptide or pharmamer of the present invention
  iii) determining whether said blood sample comprises antibodies or T-cells comprising T-cell receptors specifically binding the peptide or pharmamer of the present invention
  iv) thereby determining whether an immune response to said peptide or pharmamer has been raised in said individual.

Use of the pharmamers of the present invention for immune monitoring assays such as MHC multimer assays, ELISPOT, CFC and other assays involving formation of MHC-peptide complexes are also part of the present invention.

There is, in still further aspects, provided a diagnostic kit for ex vivo or in situ diagnosis of the presence specific T cells among PBLs or in tissue such as tumour tissue comprising one or more peptides or one or more pharmamers of the invention, and a method of detecting in a patient the presence of such reactive T cells, the method comprising contacting a tissue or a blood sample with a complex of a peptide of the invention and e.g. a Class I HLA molecule or a fragment of such molecule and detecting binding of the complex to the tissue or the blood cells.

Pharmamers Comprising Peptide Sequences

In one embodiment the present invention relates to pharmamers comprising one or more peptides. The peptides can in one embodiment be defined as outlined in the items herein below. It is to be understood that said items are not meant to be limiting to the peptide according to the present invention in that said peptide may consist of more than said 8 to 16 amino acids, but at least comprising said 8 to 16 amino acids.

Thus, in one embodiment of the present invention, the peptide may be a fragment or part of a larger protein, wherein the larger protein may be of a total length of 17, such as 18, for example 19, such as 20, for example 21, such as 22, for example 23, such as 24, for example 25, such as 26, for example 27, such as 28, for example 29, such as 30, for example 31, such as 32, for example 33, such as 34, for example 35, such as 36, for example 37, such as 38, for example 39, such as 40 amino acids, wherein 8 to 16 of said amino acids are defined in the items below. In another embodiment, the larger protein may be of a total length of between 20 to 30, such as 30-40, for example 40-50, such as 50-60, for example 60-70, such as 70-80, for example 80-90, such as 90-100, for example 100-150, such as 150-200, for example 200-250, such as 250-300, for example 300-500, such as 500-1000, for example 1000-2000, such as 2000-3000, for example 3000-4000, such as 4000-5000, for example 5000-10,000, such as 10,000-20,000, for example 20,000-30,000, such as 30,000-40,000, for example 40,000-50,000, such as 50,000-75,000, for example 75,000-100,000, such as 100,000-250,000, for example 250,000-500,000, such as 500,000-1,000,000 amino acids.

It is also to be understood, that the co-translational and post-translational modifications may occur either individually or in combination, on the same or different amino acid residues. Thus, in one embodiment, any one amino acid may be modified once, twice or three times with the same or different types of modifications. Furthermore, said identical and/or different modification may be present on 1, 2, 3, 4, 5, 6, 7, 8, 9, 10, 11, 12, 13, 14, 15, 16, 17 or 18 of the amino acid residues of the peptide according to the present invention as defined in the items below in 'the first set of items'. In addition, modifications may also be present on amino acid residues outside said 8 to 16 amino acids, in case the peptide is part of a larger protein.

First Set of Items

1. A peptide of between 8 to 16 consecutive amino acids, comprising at least 8 of amino acid number $X_1$-$X_2$-$X_3$-$X_4$-$X_5$-$X_6$-$X_7$-$X_8$-$X_9$-$X_{10}$-$X_{11}$-$X_{12}$-$X_{13}$-$X_{14}$-$X_{15}$-$X_{16}$
2. The peptide according to item 1, wherein $X_1$ is alanine
3. The peptide according to item 1, wherein $X_1$ is arginine
4. The peptide according to item 1, wherein $X_1$ is asparagine
5. The peptide according to item 1, wherein $X_1$ is aspartic acid
6. The peptide according to item 1, wherein $X_1$ is cysteine
7. The peptide according to item 1, wherein $X_1$ is glutamic acid
8. The peptide according to item 1, wherein $X_1$ is glutamine
9. The peptide according to item 1, wherein $X_1$ is glycine
10. The peptide according to item 1, wherein $X_1$ is histidine
11. The peptide according to item 1, wherein $X_1$ is isoleucine
12. The peptide according to item 1, wherein $X_1$ is leucine
13. The peptide according to item 1, wherein $X_1$ is lysine
14. The peptide according to item 1, wherein $X_1$ is methionine
15. The peptide according to item 1, wherein $X_1$ is phenylalanine
16. The peptide according to item 1, wherein $X_1$ is proline 17. The peptide according to item 1, wherein $X_1$ is serine
18. The peptide according to item 1, wherein $X_1$ is threonine
19. The peptide according to item 1, wherein $X_1$ is tryptophan
20. The peptide according to item 1, wherein $X_1$ is tyrosine
21. The peptide according to item 1, wherein $X_1$ is valine
22. The peptide according to item 1, wherein $X_2$ is alanine
23. The peptide according to item 1, wherein $X_2$ is arginine
24. The peptide according to item 1, wherein $X_2$ is asparagine
25. The peptide according to item 1, wherein $X_2$ is aspartic acid
26. The peptide according to item 1, wherein $X_2$ is cysteine
27. The peptide according to item 1, wherein $X_2$ is glutamic acid
28. The peptide according to item 1, wherein $X_2$ is glutamine
29. The peptide according to item 1, wherein $X_2$ is glycine
30. The peptide according to item 1, wherein $X_2$ is histidine
31. The peptide according to item 1, wherein $X_2$ is isoleucine
32. The peptide according to item 1, wherein $X_2$ is leucine
33. The peptide according to item 1, wherein $X_2$ is lysine
34. The peptide according to item 1, wherein $X_2$ is methionine
35. The peptide according to item 1, wherein $X_2$ is phenylalanine
36. The peptide according to item 1, wherein $X_2$ is proline
37. The peptide according to item 1, wherein $X_2$ is serine
38. The peptide according to item 1, wherein $X_2$ is threonine
39. The peptide according to item 1, wherein $X_2$ is tryptophan
40. The peptide according to item 1, wherein $X_2$ is tyrosine
41. The peptide according to item 1, wherein $X_2$ is valine
42. The peptide according to item 1, wherein $X_3$ is alanine
43. The peptide according to item 1, wherein $X_3$ is arginine
44. The peptide according to item 1, wherein $X_3$ is asparagine
45. The peptide according to item 1, wherein $X_3$ is aspartic acid
46. The peptide according to item 1, wherein $X_3$ is cysteine
47. The peptide according to item 1, wherein $X_3$ is glutamic acid
48. The peptide according to item 1, wherein $X_3$ is glutamine
49. The peptide according to item 1, wherein $X_3$ is glycine
50. The peptide according to item 1, wherein $X_3$ is histidine
51. The peptide according to item 1, wherein $X_3$ is isoleucine
52. The peptide according to item 1, wherein $X_3$ is leucine
53. The peptide according to item 1, wherein $X_3$ is lysine
54. The peptide according to item 1, wherein $X_3$ is methionine
55. The peptide according to item 1, wherein $X_3$ is phenylalanine
56. The peptide according to item 1, wherein $X_3$ is proline
57. The peptide according to item 1, wherein $X_3$ is serine
58. The peptide according to item 1, wherein $X_3$ is threonine
59. The peptide according to item 1, wherein $X_3$ is tryptophan
60. The peptide according to item 1, wherein $X_3$ is tyrosine
61. The peptide according to item 1, wherein $X_3$ is valine
62. The peptide according to item 1, wherein $X_4$ is alanine
63. The peptide according to item 1, wherein $X_4$ is arginine
64. The peptide according to item 1, wherein $X_4$ is asparagine
65. The peptide according to item 1, wherein $X_4$ is aspartic acid
66. The peptide according to item 1, wherein $X_4$ is cysteine
67. The peptide according to item 1, wherein $X_4$ is glutamic acid
68. The peptide according to item 1, wherein $X_4$ is glutamine
69. The peptide according to item 1, wherein $X_4$ is glycine
70. The peptide according to item 1, wherein $X_4$ is histidine
71. The peptide according to item 1, wherein $X_4$ is isoleucine
72. The peptide according to item 1, wherein $X_4$ is leucine
73. The peptide according to item 1, wherein $X_4$ is lysine
74. The peptide according to item 1, wherein $X_4$ is methionine
75. The peptide according to item 1, wherein $X_4$ is phenylalanine
76. The peptide according to item 1, wherein $X_4$ is proline
77. The peptide according to item 1, wherein $X_4$ is serine
78. The peptide according to item 1, wherein $X_4$ is threonine
79. The peptide according to item 1, wherein $X_4$ is tryptophan
80. The peptide according to item 1, wherein $X_4$ is tyrosine
81. The peptide according to item 1, wherein $X_4$ is valine
82. The peptide according to item 1, wherein $X_5$ is alanine
83. The peptide according to item 1, wherein $X_5$ is arginine
84. The peptide according to item 1, wherein $X_5$ is asparagine
85. The peptide according to item 1, wherein $X_5$ is aspartic acid
86. The peptide according to item 1, wherein $X_5$ is cysteine
87. The peptide according to item 1, wherein $X_5$ is glutamic acid
88. The peptide according to item 1, wherein $X_5$ is glutamine
89. The peptide according to item 1, wherein $X_5$ is glycine
90. The peptide according to item 1, wherein $X_5$ is histidine
91. The peptide according to item 1, wherein $X_5$ is isoleucine
92. The peptide according to item 1, wherein $X_5$ is leucine
93. The peptide according to item 1, wherein $X_5$ is lysine
94. The peptide according to item 1, wherein $X_5$ is methionine
95. The peptide according to item 1, wherein $X_5$ is phenylalanine
96. The peptide according to item 1, wherein $X_5$ is proline
97. The peptide according to item 1, wherein $X_5$ is serine 98. The peptide according to item 1, wherein $X_5$ is threonine
99. The peptide according to item 1, wherein $X_5$ is tryptophan
100. The peptide according to item 1, wherein $X_5$ is tyrosine
101. The peptide according to item 1, wherein $X_5$ is valine
102. The peptide according to item 1, wherein $X_6$ is alanine
103. The peptide according to item 1, wherein $X_6$ is arginine
104. The peptide according to item 1, wherein $X_6$ is asparagine
105. The peptide according to item 1, wherein $X_6$ is aspartic acid
106. The peptide according to item 1, wherein $X_6$ is cysteine
107. The peptide according to item 1, wherein $X_6$ is glutamic acid
108. The peptide according to item 1, wherein $X_6$ is glutamine
109. The peptide according to item 1, wherein $X_6$ is glycine
110. The peptide according to item 1, wherein $X_6$ is histidine
111. The peptide according to item 1, wherein $X_6$ is isoleucine
112. The peptide according to item 1, wherein $X_6$ is leucine
113. The peptide according to item 1, wherein $X_6$ is lysine
114. The peptide according to item 1, wherein $X_6$ is methionine
115. The peptide according to item 1, wherein $X_6$ is phenylalanine
116. The peptide according to item 1, wherein $X_6$ is proline
117. The peptide according to item 1, wherein $X_6$ is serine
118. The peptide according to item 1, wherein $X_6$ is threonine
119. The peptide according to item 1, wherein $X_6$ is tryptophan
120. The peptide according to item 1, wherein $X_6$ is tyrosine
121. The peptide according to item 1, wherein $X_6$ is valine
122. The peptide according to item 1, wherein $X_7$ is alanine
123. The peptide according to item 1, wherein $X_7$ is arginine
124. The peptide according to item 1, wherein $X_7$ is asparagine
125. The peptide according to item 1, wherein $X_7$ is aspartic acid
126. The peptide according to item 1, wherein $X_7$ is cysteine
127. The peptide according to item 1, wherein $X_7$ is glutamic acid
128. The peptide according to item 1, wherein $X_7$ is glutamine
129. The peptide according to item 1, wherein $X_7$ is glycine
130. The peptide according to item 1, wherein $X_7$ is histidine
131. The peptide according to item 1, wherein $X_7$ is isoleucine
132. The peptide according to item 1, wherein $X_7$ is leucine
133. The peptide according to item 1, wherein $X_7$ is lysine
134. The peptide according to item 1, wherein $X_7$ is methionine
135. The peptide according to item 1, wherein $X_7$ is phenylalanine
136. The peptide according to item 1, wherein $X_7$ is proline
137. The peptide according to item 1, wherein $X_7$ is serine
138. The peptide according to item 1, wherein $X_7$ is threonine
139. The peptide according to item 1, wherein $X_7$ is tryptophan
140. The peptide according to item 1, wherein $X_7$ is tyrosine
141. The peptide according to item 1, wherein $X_7$ is valine
142. The peptide according to item 1, wherein $X_8$ is alanine
143. The peptide according to item 1, wherein $X_8$ is arginine
144. The peptide according to item 1, wherein $X_8$ is asparagine
145. The peptide according to item 1, wherein $X_8$ is aspartic acid
146. The peptide according to item 1, wherein $X_8$ is cysteine
147. The peptide according to item 1, wherein $X_8$ is glutamic acid
148. The peptide according to item 1, wherein $X_8$ is glutamine
149. The peptide according to item 1, wherein $X_8$ is glycine
150. The peptide according to item 1, wherein $X_8$ is an histidine
151. The peptide according to item 1, wherein $X_8$ is isoleucine
152. The peptide according to item 1, wherein $X_8$ is leucine
153. The peptide according to item 1, wherein $X_8$ is lysine
154. The peptide according to item 1, wherein $X_8$ is methionine
155. The peptide according to item 1, wherein $X_8$ is phenylalanine
156. The peptide according to item 1, wherein $X_8$ is proline
157. The peptide according to item 1, wherein $X_8$ is serine
158. The peptide according to item 1, wherein $X_8$ is threonine
159. The peptide according to item 1, wherein $X_8$ is tryptophan
160. The peptide according to item 1, wherein $X_8$ is tyrosine
161. The peptide according to item 1, wherein $X_8$ is valine
162. The peptide according to item 1, wherein $X_9$ is alanine
163. The peptide according to item 1, wherein $X_9$ is arginine
164. The peptide according to item 1, wherein $X_9$ is asparagine
165. The peptide according to item 1, wherein $X_9$ is aspartic acid
166. The peptide according to item 1, wherein $X_9$ is cysteine
167. The peptide according to item 1, wherein $X_9$ is glutamic acid
168. The peptide according to item 1, wherein $X_9$ is glutamine
169. The peptide according to item 1, wherein $X_9$ is glycine 170. The peptide according to item 1, wherein $X_9$ is an histidine
171. The peptide according to item 1, wherein $X_9$ is isoleucine
172. The peptide according to item 1, wherein $X_9$ is leucine
173. The peptide according to item 1, wherein $X_9$ is lysine
174. The peptide according to item 1, wherein $X_9$ is methionine
175. The peptide according to item 1, wherein $X_9$ is phenylalanine
176. The peptide according to item 1, wherein $X_9$ is proline
177. The peptide according to item 1, wherein $X_9$ is serine
178. The peptide according to item 1, wherein $X_9$ is threonine
179. The peptide according to item 1, wherein $X_9$ is tryptophan
180. The peptide according to item 1, wherein $X_9$ is tyrosine
181. The peptide according to item 1, wherein $X_9$ is valine
182. The peptide according to item 1, wherein $X_9$ is alanine
183. The peptide according to item 1, wherein $X_9$ is arginine
184. The peptide according to item 1, wherein $X_9$ is asparagine
185. The peptide according to item 1, wherein $X_9$ is aspartic acid
186. The peptide according to item 1, wherein $X_9$ is cysteine
187. The peptide according to item 1, wherein $X_9$ is glutamic acid
188. The peptide according to item 1, wherein $X_9$ is glutamine
189. The peptide according to item 1, wherein $X_9$ is glycine
190. The peptide according to item 1, wherein $X_9$ is an histidine
191. The peptide according to item 1, wherein $X_9$ is isoleucine
192. The peptide according to item 1, wherein $X_9$ is leucine
193. The peptide according to item 1, wherein $X_9$ is lysine
194. The peptide according to item 1, wherein $X_9$ is methionine
195. The peptide according to item 1, wherein $X_9$ is phenylalanine
196. The peptide according to item 1, wherein $X_9$ is proline
197. The peptide according to item 1, wherein $X_9$ is serine
198. The peptide according to item 1, wherein $X_9$ is threonine
199. The peptide according to item 1, wherein $X_9$ is tryptophan
200. The peptide according to item 1, wherein $X_9$ is tyrosine
201. The peptide according to item 1, wherein $X_9$ is valine
202. The peptide according to item 1, wherein $X_{10}$ is alanine
203. The peptide according to item 1, wherein $X_{10}$ is arginine
204. The peptide according to item 1, wherein $X_{10}$ is asparagine
205. The peptide according to item 1, wherein $X_{10}$ is aspartic acid
206. The peptide according to item 1, wherein $X_{10}$ is cysteine
207. The peptide according to item 1, wherein $X_{10}$ is glutamic acid
208. The peptide according to item 1, wherein $X_{10}$ is glutamine
209. The peptide according to item 1, wherein $X_{10}$ is glycine
210. The peptide according to item 1, wherein $X_{10}$ is an histidine
211. The peptide according to item 1, wherein $X_{10}$ is isoleucine
212. The peptide according to item 1, wherein $X_{10}$ is leucine
213. The peptide according to item 1, wherein $X_{10}$ is lysine
214. The peptide according to item 1, wherein $X_{10}$ is methionine
215. The peptide according to item 1, wherein $X_{10}$ is phenylalanine
216. The peptide according to item 1, wherein $X_{10}$ is proline
217. The peptide according to item 1, wherein $X_{10}$ is serine
218. The peptide according to item 1, wherein $X_{10}$ is threonine
219. The peptide according to item 1, wherein $X_{10}$ is tryptophan
220. The peptide according to item 1, wherein $X_{10}$ is tyrosine
221. The peptide according to item 1, wherein $X_{10}$ is valine
222. The peptide according to item 1, wherein $X_{11}$ is alanine
223. The peptide according to item 1, wherein $X_{11}$ is arginine
224. The peptide according to item 1, wherein $X_{11}$ is asparagine
225. The peptide according to item 1, wherein $X_{11}$ is aspartic acid
226. The peptide according to item 1, wherein $X_{11}$ is cysteine
227. The peptide according to item 1, wherein $X_{11}$ is glutamic acid
228. The peptide according to item 1, wherein $X_{11}$ is glutamine
229. The peptide according to item 1, wherein $X_{11}$ is glycine
230. The peptide according to item 1, wherein $X_{11}$ is an histidine
231. The peptide according to item 1, wherein $X_{11}$ is isoleucine
232. The peptide according to item 1, wherein $X_{11}$ is leucine
233. The peptide according to item 1, wherein $X_{11}$ is lysine
234. The peptide according to item 1, wherein $X_{11}$ is methionine
235. The peptide according to item 1, wherein $X_{11}$ is phenylalanine
236. The peptide according to item 1, wherein $X_{11}$ is proline
237. The peptide according to item 1, wherein $X_{11}$ is serine
238. The peptide according to item 1, wherein $X_{11}$ is threonine 239. The peptide according to item 1, wherein $X_{11}$ is tryptophan
240. The peptide according to item 1, wherein $X_{11}$ is tyrosine
241. The peptide according to item 1, wherein $X_{11}$ is valine
242. The peptide according to item 1, wherein $X_{12}$ is alanine
243. The peptide according to item 1, wherein $X_{12}$ is arginine
244. The peptide according to item 1, wherein $X_{12}$ is asparagine
245. The peptide according to item 1, wherein $X_{12}$ is aspartic acid
246. The peptide according to item 1, wherein $X_{12}$ is cysteine
247. The peptide according to item 1, wherein $X_{12}$ is glutamic acid
248. The peptide according to item 1, wherein $X_{12}$ is glutamine
249. The peptide according to item 1, wherein $X_{12}$ is glycine
250. The peptide according to item 1, wherein $X_{12}$ is histidine
251. The peptide according to item 1, wherein $X_{12}$ is isoleucine
252. The peptide according to item 1, wherein $X_{12}$ is leucine
253. The peptide according to item 1, wherein $X_{12}$ is lysine
254. The peptide according to item 1, wherein $X_{12}$ is methionine
255. The peptide according to item 1, wherein $X_{12}$ is phenylalanine
256. The peptide according to item 1, wherein $X_{12}$ is proline
257. The peptide according to item 1, wherein $X_{12}$ is serine
258. The peptide according to item 1, wherein $X_{12}$ is threonine
259. The peptide according to item 1, wherein $X_{12}$ is tryptophan
260. The peptide according to item 1, wherein $X_{12}$ is tyrosine
261. The peptide according to item 1, wherein $X_{12}$ is valine
262. The peptide according to item 1, wherein $X_{13}$ is alanine
263. The peptide according to item 1, wherein $X_{13}$ is arginine
264. The peptide according to item 1, wherein $X_{13}$ is asparagine
265. The peptide according to item 1, wherein $X_{13}$ is aspartic acid
266. The peptide according to item 1, wherein $X_{13}$ is cysteine
267. The peptide according to item 1, wherein $X_{13}$ is glutamic acid
268. The peptide according to item 1, wherein $X_{13}$ is glutamine
269. The peptide according to item 1, wherein $X_{13}$ is glycine
270. The peptide according to item 1, wherein $X_{13}$ is histidine
271. The peptide according to item 1, wherein $X_{13}$ is isoleucine
272. The peptide according to item 1, wherein $X_{13}$ is leucine
273. The peptide according to item 1, wherein $X_{13}$ is lysine
274. The peptide according to item 1, wherein $X_{13}$ is methionine
275. The peptide according to item 1, wherein $X_{13}$ is phenylalanine
276. The peptide according to item 1, wherein $X_{13}$ is proline
277. The peptide according to item 1, wherein $X_{13}$ is serine
278. The peptide according to item 1, wherein $X_{13}$ is threonine
279. The peptide according to item 1, wherein $X_{13}$ is tryptophan
280. The peptide according to item 1, wherein $X_{13}$ is tyrosine
281. The peptide according to item 1, wherein $X_{13}$ is valine
282. The peptide according to item 1, wherein $X_{14}$ is alanine
283. The peptide according to item 1, wherein $X_{14}$ is arginine
284. The peptide according to item 1, wherein $X_{14}$ is asparagine
285. The peptide according to item 1, wherein $X_{14}$ is aspartic acid
286. The peptide according to item 1, wherein $X_{14}$ is cysteine
287. The peptide according to item 1, wherein $X_{14}$ is glutamic acid
288. The peptide according to item 1, wherein $X_{14}$ is glutamine
289. The peptide according to item 1, wherein $X_{14}$ is glycine
290. The peptide according to item 1, wherein $X_{14}$ is histidine
291. The peptide according to item 1, wherein $X_{14}$ is isoleucine
292. The peptide according to item 1, wherein $X_{14}$ is leucine
293. The peptide according to item 1, wherein $X_{14}$ is lysine
294. The peptide according to item 1, wherein $X_{14}$ is methionine
295. The peptide according to item 1, wherein $X_{14}$ is phenylalanine
296. The peptide according to item 1, wherein $X_{14}$ is proline
297. The peptide according to item 1, wherein $X_{14}$ is serine
298. The peptide according to item 1, wherein $X_{14}$ is threonine
299. The peptide according to item 1, wherein $X_{14}$ is tryptophan
300. The peptide according to item 1, wherein $X_{14}$ is tyrosine
301. The peptide according to item 1, wherein $X_{14}$ is valine
302. The peptide according to item 1, wherein $X_{15}$ is alanine
303. The peptide according to item 1, wherein $X_{15}$ is arginine
304. The peptide according to item 1, wherein $X_{15}$ is asparagine 305. The peptide according to item 1, wherein $X_{15}$ is aspartic acid
306. The peptide according to item 1, wherein $X_{15}$ is cysteine
307. The peptide according to item 1, wherein $X_{15}$ is glutamic acid
308. The peptide according to item 1, wherein $X_{15}$ is glutamine
309. The peptide according to item 1, wherein $X_{15}$ is glycine
310. The peptide according to item 1, wherein $X_{15}$ is histidine
311. The peptide according to item 1, wherein $X_{15}$ is isoleucine
312. The peptide according to item 1, wherein $X_{15}$ is leucine
313. The peptide according to item 1, wherein $X_{15}$ is lysine
314. The peptide according to item 1, wherein $X_{15}$ is methionine
315. The peptide according to item 1, wherein $X_{15}$ is phenylalanine
316. The peptide according to item 1, wherein $X_{15}$ is proline
317. The peptide according to item 1, wherein $X_{15}$ is serine
318. The peptide according to item 1, wherein $X_{15}$ is threonine
319. The peptide according to item 1, wherein $X_{15}$ is tryptophan
320. The peptide according to item 1, wherein $X_{15}$ is tyrosine
321. The peptide according to item 1, wherein $X_{15}$ is valine
322. The peptide according to item 1, wherein $X_{16}$ is alanine
323. The peptide according to item 1, wherein $X_{16}$ is arginine
324. The peptide according to item 1, wherein $X_{16}$ is asparagine
325. The peptide according to item 1, wherein $X_{16}$ is aspartic acid
326. The peptide according to item 1, wherein $X_{16}$ is cysteine
327. The peptide according to item 1, wherein $X_{16}$ is glutamic acid
328. The peptide according to item 1, wherein $X_{16}$ is glutamine
329. The peptide according to item 1, wherein $X_{16}$ is glycine
330. The peptide according to item 1, wherein $X_{16}$ is histidine
331. The peptide according to item 1, wherein $X_{16}$ is isoleucine
332. The peptide according to item 1, wherein $X_{16}$ is leucine
333. The peptide according to item 1, wherein $X_{16}$ is lysine
334. The peptide according to item 1, wherein $X_{16}$ is methionine
335. The peptide according to item 1, wherein $X_{16}$ is phenylalanine
336. The peptide according to item 1, wherein $X_{16}$ is proline
337. The peptide according to item 1, wherein $X_{16}$ is serine
338. The peptide according to item 1, wherein $X_{16}$ is threonine
339. The peptide according to item 1, wherein $X_{16}$ is tryptophan
340. The peptide according to item 1, wherein $X_{16}$ is tyrosine
341. The peptide according to item 1, wherein $X_{16}$ is valine
342. The peptide according to any of items 2, 22, 42, 62, 82, 102, 122, 142, 162, 182, 202, 222, 242, 262, 282, 302 or 322, wherein the alanine is D-alanine
343. The peptide according to any of items 2, 22, 42, 62, 82, 102, 122, 142, 162, 182, 202, 222, 242, 262, 282, 302 or 322, wherein the alanine is L-alanine
344. The peptide according to any of items 3, 23, 43, 63, 83, 103, 123, 143, 163, 183, 203, 223, 243, 263, 283, 303 or 323, wherein the arginine is D-arginine
345. The peptide according to any of items 3, 23, 43, 63, 83, 103, 123, 143, 163, 183, 203, 223, 243, 263, 283, 303 or 323, wherein the arginine is L-arginine
346. The peptide according to any of items 4, 24, 44, 64, 84, 104, 124, 144, 164, 184, 204, 224, 244, 264, 284, 304 or 324, wherein the asparagine is D-asparagine
347. The peptide according to any of items 4, 24, 44, 64, 84, 104, 124, 144, 164, 184, 204, 224, 244, 264, 284, 304 or 324, wherein the asparagine is L-asparagine
348. The peptide according to any of items 5, 25, 45, 65, 85, 105, 125, 145, 165, 185, 205, 225, 245, 265, 285, 305 or 325, wherein the aspartic acid is D-aspartic acid
349. The peptide according to any of items 5, 25, 45, 65, 85, 105, 125, 145, 165, 185, 205, 225, 245, 265, 285, 305 or 325, wherein the aspartic acid is L-aspartic acid
350. The peptide according to any of items 6, 26, 46, 66, 86, 106, 126, 146, 166, 186, 206, 226, 246, 266, 286, 306 or 326, wherein the cysteine is D-cysteine
351. The peptide according to any of items 6, 26, 46, 66, 86, 106, 126, 146, 166, 186, 206, 226, 246, 266, 286, 306 or 326, wherein the cysteine is L-cysteine
352. The peptide according to any of items 7, 27, 47, 67, 87, 107, 127, 147, 167, 187, 207, 227, 247, 267, 287, 307 or 327, wherein the glutamic acid is D-glutamic acid
353. The peptide according to any of items 7, 27, 47, 67, 87, 107, 127, 147, 167, 187, 207, 227, 247, 267, 287, 307 or 327, wherein the glutamic acid is L-glutamic acid
354. The peptide according to any of items 8, 28, 48, 68, 88, 108, 128, 148, 168, 188, 208, 228, 248, 268, 288, 308 or 328, wherein the glutamine is D-glutamine
355. The peptide according to any of items 8, 28, 48, 68, 88, 108, 128, 148, 168, 188, 208, 228, 248, 268, 288, 308 or 328, wherein the glutamine is L-glutamine
356. The peptide according to any of items 9, 29, 49, 69, 89, 109, 129, 149, 169, 189, 209, 229, 249, 269, 289, 309 or 329, wherein the glycine is D-glycine
357. The peptide according to any of items 9, 29, 49, 69, 89, 109, 129, 149, 169, 189, 209, 229, 249, 269, 289, 309 or 329, wherein the glycine is L-glycine
358. The peptide according to any of items 10, 30, 50, 70, 90, 110, 130, 150, 170, 190, 210, 230, 250, 270, 290, 310 or 330, wherein the histidine is D-histidine
359. The peptide according to any of items 10, 30, 50, 70, 90, 110, 130, 150, 170, 190, 210, 230, 250, 270, 290, 310 or 330, wherein the histidine is L-histidine
360. The peptide according to any of items 11, 31, 51, 71, 91, 111, 131, 151, 171, 191, 211, 231, 251, 271, 291, 311 or 331, wherein the isoleucine is D-isoleucine 361. The peptide according to any of items 11, 31, 51, 71, 91, 111, 131, 151, 171, 191, 211, 231, 251, 271, 291, 311 or 331, wherein the isoleucine is L-isoleucine
362. The peptide according to any of items 12, 32, 52, 72, 92, 112, 132, 152, 172, 192, 212, 232, 252, 272, 292, 312 or 332, wherein the leucine is D-leucine
363. The peptide according to any of items 12, 32, 52, 72, 92, 112, 132, 152, 172, 192, 212, 232, 252, 272, 292, 312 or 332, wherein the leucine is L-leucine
364. The peptide according to any of items 13, 33, 53, 73, 93, 113, 133, 153, 173, 193, 213, 233, 253, 273, 293, 313 or 333, wherein the lysine is D-lysine
365. The peptide according to any of items 13, 33, 53, 73, 93, 113, 133, 153, 173, 193, 213, 233, 253, 273, 293, 313 or 333, wherein the lysine is L-lysine
366. The peptide according to any of items 14, 34, 54, 74, 94, 114, 134, 154, 174, 194, 214, 234, 254, 274, 294, 314 or 334, wherein the methionine is D-methionine
367. The peptide according to any of items 14, 34, 54, 74, 94, 114, 134, 154, 174, 194, 214, 234, 254, 274, 294, 314 or 334, wherein the methionine is L-methionine
368. The peptide according to any of items 15, 35, 55, 75, 95, 115, 135, 155, 175, 195, 215, 235, 255, 275, 295, 315 or 335, wherein the phenylalanine is D-phenylalanine
369. The peptide according to any of items 15, 35, 55, 75, 95, 115, 135, 155, 175, 195, 215, 235, 255, 275, 295, 315 or 335, wherein the phenylalanine is L-phenylalanine
370. The peptide according to any of items 16, 36, 56, 76, 96, 116, 136, 156, 176, 196, 216, 236, 256, 276, 296, 316 or 336, wherein the proline is D-proline
371. The peptide according to any of items 16, 36, 56, 76, 96, 116, 136, 156, 176, 196, 216, 236, 256, 276, 296, 316 or 336, wherein the proline is L-proline
372. The peptide according to any of items 17, 37, 57, 77, 97, 117, 137, 157, 177, 197, 217, 237, 257, 277, 297, 317 or 337, wherein the serine is D-serine
373. The peptide according to any of items 17, 37, 57, 77, 97, 117, 137, 157, 177, 197, 217, 237, 257, 277, 297, 317 or 337, wherein the serine is L-serine
374. The peptide according to any of items 18, 38, 58, 78, 98, 118, 138, 158, 178, 198, 218, 238, 258, 278, 298, 318 or 338, wherein the threonine is D-threonine
375. The peptide according to any of items 18, 38, 58, 78, 98, 118, 138, 158, 178, 198, 218, 238, 258, 278, 298, 318 or 338, wherein the threonine is L-threonine
376. The peptide according to any of items 19, 39, 59, 79, 99, 119, 139, 159, 179, 199, 219, 239, 259, 279, 299, 319 or 339, wherein the tryptophan is D-tryptophan
377. The peptide according to any of items 19, 39, 59, 79, 99, 119, 139, 159, 179, 199, 219, 239, 259, 279, 299, 319 or 339, wherein the tryptophan is L-tryptophan
378. The peptide according to any of items 20, 40, 60, 80, 100, 120, 140, 160, 180, 200, 220, 240, 260, 280, 300, 320 or 340, wherein the tyrosine is D-tyrosine
379. The peptide according to any of items 20, 40, 60, 80, 100, 120, 140, 160, 180, 200, 220, 240, 260, 280, 300, 320 or 340, wherein the tyrosine is L-tyrosine
380. The peptide according to any of items 21, 41, 61, 81, 101, 121, 141, 161, 181, 201, 221, 241, 261, 281, 301, 321 or 341, wherein the valine is D-valine
381. The peptide according to any of items 21, 41, 61, 81, 101, 121, 141, 161, 181, 201, 221, 241, 261, 281, 301, 321 or 341, wherein the valine is L-valine
382. The peptide according to item 1 to 381, wherein one or more of said amino acid residues are modified, such as post-translationally modified or co-translationally modified
383. The peptide according to item 382, wherein said modification is acetylation of one or more amino acid residues
384. The peptide according to item 382, wherein said modification is phosphorylation of one or more amino acid residues
385. The peptide according to item 382, wherein said modification is glycosylation of one or more amino acid residues
386. The peptide according to item 382, wherein said modification is non-enzymatic glycosylation (or glycation) of one or more amino acid residues
387. The peptide according to item 382, wherein said modification is methylation of one or more amino acid residues
388. The peptide according to item 382, wherein said modification is amidation of one or more amino acid residues
389. The peptide according to item 382, wherein said modification is deamidation of one or more amino acid residues
390. The peptide according to item 382, wherein said modification is succinimide formation of one or more amino acid residues
391. The peptide according to item 382, wherein said modification is biotinylation of one or more amino acid residues
392. The peptide according to item 382, wherein said modification is formylation of one or more amino acid residues
393. The peptide according to item 382, wherein said modification is carboxylation of one or more amino acid residues
394. The peptide according to item 382, wherein said modification is carbamylation of one or more amino acid residues
395. The peptide according to item 382, wherein said modification is hydroxylation of one or more amino acid residues
396. The peptide according to item 382, wherein said modification is iodination of one or more amino acid residues
397. The peptide according to item 382, wherein said modification is isoprenylation (or prenylation or lipidation or lipoylation) of one or more amino acid residues
398. The peptide according to item 382, wherein said modification is GPI (glycosyl phosphatidylinositol) anchor formation of one or more amino acid residues
399. The peptide according to item 382, wherein said modification is myristoylation of one or more amino acid residues
400. The peptide according to item 382, wherein said modification is farnesylation of one or more amino acid residues
401. The peptide according to item 382, wherein said modification is geranylgeranylation of one or more amino acid residues
402. The peptide according to item 382, wherein said modification is covalent attachment of nucleotides or derivates thereof to one or more amino acid residues 403. The peptide according to item 382, wherein said modification is ADP-ribosylation of one or more amino acid residues
404. The peptide according to item 382, wherein said modification is flavin attachment to one or more amino acid residues
405. The peptide according to item 382, wherein said modification is oxidation of one or more amino acid residues
406. The peptide according to item 382, wherein said modification is oxidative deamination of one or more amino acid residues
407. The peptide according to item 382, wherein said modification is deamination of one or more amino acid residues
408. The peptide according to item 382, wherein said modification is palmitoylation of one or more amino acid residues
409. The peptide according to item 382, wherein said modification is pegylation of one or more amino acid residues
410. The peptide according to item 382, wherein said modification is attachment of phosphatidyl-inositol of one or more amino acid residues
411. The peptide according to item 382, wherein said modification is phosphopantetheinylation of one or more amino acid residues
412. The peptide according to item 382, wherein said modification is polysialylation of one or more amino acid residues
413. The peptide according to item 382, wherein said modification is sulfation of one or more amino acid residues
414. The peptide according to item 382, wherein said modification is selenoylation of one or more amino acid residues
415. The peptide according to item 382, wherein said modification is arginylation of one or more amino acid residues
416. The peptide according to item 382, wherein said modification is glutamylation or polyglutamylation of one or more amino acid residues
417. The peptide according to item 382, wherein said modification is glycylation or polyglycylation of one or more amino acid residues
418. The peptide according to item 382, wherein said modification is acylation (or alkanoylation) of one or more amino acid residues
419. The peptide according to item 382, wherein said modification is Methylidene-imidazolone (MIO) formation of one or more amino acid residues
420. The peptide according to item 382, wherein said modification is p-Hydroxybenzylidene-imidazolone formation of one or more amino acid residues
421. The peptide according to item 382, wherein said modification is Lysine tyrosyl quinone (LTQ) formation of one or more amino acid residues
422. The peptide according to item 382, wherein said modification is Topaquinone (TPQ) formation of one or more amino acid residues
423. The peptide according to item 382, wherein said modification is Porphyrin ring linkage of one or more amino acid residues
424. The peptide according to item 382, wherein said modification is glypiation (addition of glycosyl phosphatidyl inositol) of one or more amino acid residues
425. The peptide according to item 382, wherein said modification is addition of heme to one or more amino acid residues
426. The peptide according to item 382, wherein said modification is ubiquitination of one or more amino acid residues
427. The peptide according to item 382, wherein said modification is SUMOylation (Small Ubiquitin-like Modifier) of one or more amino acid residues
428. The peptide according to item 382, wherein said modification is ISGylation of one or more amino acid residues
429. The peptide according to item 382, wherein said modification is citrullination (or deimination) of one or more amino acid residues
430. The peptide according to item 382, wherein said modification is the formation of pyroglutamic acid (or pidolic acid) of one or more amino acid residues
431. The peptide according to item 382, wherein said modification is formation of disulfide bridges (or disulfide bond or SS-bond or persulfide connection) between two amino acid residues
432. The peptide according to item 382, wherein said modification is formation of a desmosine cross-link between two or more amino acid residues
433. The peptide according to item 382, wherein said modification is transglutamination between two or more amino acid residues
434. The peptide according to item 1, wherein any of $X_1$, $X_2$, $X_3$, $X_4$, $X_5$, $X_6$, $X_7$, $X_8$, $X_9$, $X_{10}$, $X_{11}$, $X_{12}$, $X_{13}$, $X_{14}$, $X_{15}$ and/or $X_{16}$ is an uncommon or modified amino acid
435. The peptide according to item 434, wherein said uncommon amino acid is acetylalanine
436. The peptide according to item 434, wherein said uncommon amino acid is acetylaspartic acid
437. The peptide according to item 434, wherein said uncommon amino acid is acetylcysteine
438. The peptide according to item 434, wherein said uncommon amino acid is acetylglutamic acid
439. The peptide according to item 434, wherein said uncommon amino acid is acetylglutamine
440. The peptide according to item 434, wherein said uncommon amino acid is acetylglycine
441. The peptide according to item 434, wherein said uncommon amino acid is acetylisoleucine
442. The peptide according to item 434, wherein said uncommon amino acid is acetyllysine
443. The peptide according to item 434, wherein said uncommon amino acid is acetylmethionine
444. The peptide according to item 434, wherein said uncommon amino acid is acetylproline
445. The peptide according to item 434, wherein said uncommon amino acid is acetylserine
446. The peptide according to item 434, wherein said uncommon amino acid is acetylthreonine
447. The peptide according to item 434, wherein said uncommon amino acid is acetyltyrosine
448. The peptide according to item 434, wherein said uncommon amino acid is acetylvaline
449. The peptide according to item 434, wherein said uncommon amino acid is acetyllysine
450. The peptide according to item 434, wherein said uncommon amino acid is acetylcysteine
451. The peptide according to item 434, wherein said uncommon amino acid is alanine amide
452. The peptide according to item 434, wherein said uncommon amino acid is arginine amide 453. The peptide according to item 434, wherein said uncommon amino acid is asparagine amide
454. The peptide according to item 434, wherein said uncommon amino acid is aspartic acid amide
455. The peptide according to item 434, wherein said uncommon amino acid is cysteine amide
456. The peptide according to item 434, wherein said uncommon amino acid is glutamine amide
457. The peptide according to item 434, wherein said uncommon amino acid is glutamic acid amide
458. The peptide according to item 434, wherein said uncommon amino acid is glycine amide
459. The peptide according to item 434, wherein said uncommon amino acid is histidine amide
460. The peptide according to item 434, wherein said uncommon amino acid is isoleucine amide
461. The peptide according to item 434, wherein said uncommon amino acid is leucine amide
462. The peptide according to item 434, wherein said uncommon amino acid is lysine amide
463. The peptide according to item 434, wherein said uncommon amino acid is methionine amide
464. The peptide according to item 434, wherein said uncommon amino acid is phenylalanine amide
465. The peptide according to item 434, wherein said uncommon amino acid is proline amide
466. The peptide according to item 434, wherein said uncommon amino acid is serine amide
467. The peptide according to item 434, wherein said uncommon amino acid is threonine amide
468. The peptide according to item 434, wherein said uncommon amino acid is tryptophan amide
469. The peptide according to item 434, wherein said uncommon amino acid is tyrosine amide
470. The peptide according to item 434, wherein said uncommon amino acid is valine amide
471. The peptide according to item 434, wherein said uncommon amino acid is an amino acid alcohol
472. The peptide according to item 434, wherein said uncommon amino acid is Aminobenzoic Acid
473. The peptide according to item 434, wherein said uncommon amino acid is Aminobutyric Acid
474. The peptide according to item 434, wherein said uncommon amino acid is Aminocyanobutyric acid
475. The peptide according to item 434, wherein said uncommon amino acid is Aminocyanopropionic acid
476. The peptide according to item 434, wherein said uncommon amino acid is Aminocyclohexanoic acid
477. The peptide according to item 434, wherein said uncommon amino acid is Aminocyclopropanoic acid
478. The peptide according to item 434, wherein said uncommon amino acid is Aminocylopentanoic acid
479. The peptide according to item 434, wherein said uncommon amino acid is Aminodecanoic acid
480. The peptide according to item 434, wherein said uncommon amino acid is Aminododecanoic acid
481. The peptide according to item 434, wherein said uncommon amino acid is Aminohexanoic acid
482. The peptide according to item 434, wherein said uncommon amino acid is Aminoisobutyric acid
483. The peptide according to item 434, wherein said uncommon amino acid is Aminomethylbenzoic acid
484. The peptide according to item 434, wherein said uncommon amino acid is Aminomethylcyclohexanoic acid
485. The peptide according to item 434, wherein said uncommon amino acid is Aminononanoic acid
486. The peptide according to item 434, wherein said uncommon amino acid is Aminooctanoic acid
487. The peptide according to item 434, wherein said uncommon amino acid is Aminophenylalanine
488. The peptide according to item 434, wherein said uncommon amino acid is Amino Salicylic acid
489. The peptide according to item 434, wherein said uncommon amino acid is 2-Amino-2-Thiazoline-4-carboxylic acid
490. The peptide according to item 434, wherein said uncommon amino acid is Aminoundecanoic acid
491. The peptide according to item 434, wherein said uncommon amino acid is Aminovaleric acid
492. The peptide according to item 434, wherein said uncommon amino acid is 4-Benzoylphenylalanine
493. The peptide according to item 434, wherein said uncommon amino acid is Biphenylalanine
494. The peptide according to item 434, wherein said uncommon amino acid is Bromophenylalanine
495. The peptide according to item 434, wherein said uncommon amino acid is gamma-Carboxyglutamic acid
496. The peptide according to item 434, wherein said uncommon amino acid is canavanine
497. The peptide according to item 434, wherein said uncommon amino acid is Carnitine
498. The peptide according to item 434, wherein said uncommon amino acid is Chlorophenylalanine
499. The peptide according to item 434, wherein said uncommon amino acid is Chlorotyrosine
500. The peptide according to item 434, wherein said uncommon amino acid is Cine
501. The peptide according to item 434, wherein said uncommon amino acid is Citrulline
502. The peptide according to item 434, wherein said uncommon amino acid is 4-Cyano-2-Aminobutyric acid
503. The peptide according to item 434, wherein said uncommon amino acid is Cyclohexylalanine
504. The peptide according to item 434, wherein said uncommon amino acid is Cyclohexylglycine
505. The peptide according to item 434, wherein said uncommon amino acid is Diaminobenzoic acid
506. The peptide according to item 434, wherein said uncommon amino acid is 2,4-Diaminobutyric acid
507. The peptide according to item 434, wherein said uncommon amino acid is 2,3-Diaminopropionic acid
508. The peptide according to item 434, wherein said uncommon amino acid is Dibutylglycine
509. The peptide according to item 434, wherein said uncommon amino acid is Diethylglycine
510. The peptide according to item 434, wherein said uncommon amino acid is Dihydrotryptophan
511. The peptide according to item 434, wherein said uncommon amino acid is Dipropylglycine
512. The peptide according to item 434, wherein said uncommon amino acid is Fluorophenylalanine
513. The peptide according to item 434, wherein said uncommon amino acid is formylmethionine
514. The peptide according to item 434, wherein said uncommon amino acid is formylglycine
515. The peptide according to item 434, wherein said uncommon amino acid is formyllysine
516. The peptide according to item 434, wherein said uncommon amino acid is farnesylcysteine
517. The peptide according to item 434, wherein said uncommon amino acid is hydroxyfarnesylcysteine 518. The peptide according to item 434, wherein said uncommon amino acid is Homoalanine
519. The peptide according to item 434, wherein said uncommon amino acid is Homoarginine
520. The peptide according to item 434, wherein said uncommon amino acid is Homoasparagine
521. The peptide according to item 434, wherein said uncommon amino acid is Homoaspartic acid
522. The peptide according to item 434, wherein said uncommon amino acid is Homoglutamic acid
523. The peptide according to item 434, wherein said uncommon amino acid is Homoglutamine
524. The peptide according to item 434, wherein said uncommon amino acid is Homoisoleucine
525. The peptide according to item 434, wherein said uncommon amino acid is Homophenylalanine
526. The peptide according to item 434, wherein said uncommon amino acid is Homoserine
527. The peptide according to item 434, wherein said uncommon amino acid is Homotyrosine
528. The peptide according to item 434, wherein said uncommon amino acid is Hydroxyproline
529. The peptide according to item 434, wherein said uncommon amino acid is Hydroxylysine
530. The peptide according to item 434, wherein said uncommon amino acid is 2-Indanylglycine
531. The peptide according to item 434, wherein said uncommon amino acid is 2-Indolecarboxylic acid
532. The peptide according to item 434, wherein said uncommon amino acid is Indoleglycine
533. The peptide according to item 434, wherein said uncommon amino acid is Iodophenylalanine
534. The peptide according to item 434, wherein said uncommon amino acid is Isonipecotic Acid
535. The peptide according to item 434, wherein said uncommon amino acid is Kynurenine
536. The peptide according to item 434, wherein said uncommon amino acid is β-(S-Benzyl)Mercapto-β,β-cyclopentamethylene propionic acid
537. The peptide according to item 434, wherein said uncommon amino acid is Methyltyrosine
538. The peptide according to item 434, wherein said uncommon amino acid is Methylphenylalanine
539. The peptide according to item 434, wherein said uncommon amino acid is methylalanine
540. The peptide according to item 434, wherein said uncommon amino acid is trimethylalanine
541. The peptide according to item 434, wherein said uncommon amino acid is methylglycine
542. The peptide according to item 434, wherein said uncommon amino acid is methylmethionine
543. The peptide according to item 434, wherein said uncommon amino acid is methylphenylalanine
544. The peptide according to item 434, wherein said uncommon amino acid is dimethylproline
545. The peptide according to item 434, wherein said uncommon amino acid is dimethylarginine
546. The peptide according to item 434, wherein said uncommon amino acid is methylarginine
547. The peptide according to item 434, wherein said uncommon amino acid is methylasparagine
548. The peptide according to item 434, wherein said uncommon amino acid is methylglutamine
549. The peptide according to item 434, wherein said uncommon amino acid is methylhistidine
550. The peptide according to item 434, wherein said uncommon amino acid is trimethyllysine
551. The peptide according to item 434, wherein said uncommon amino acid is dimethyllysine
552. The peptide according to item 434, wherein said uncommon amino acid is methyllysine
553. The peptide according to item 434, wherein said uncommon amino acid is methylcysteine
554. The peptide according to item 434, wherein said uncommon amino acid is glutamic acid 5-methyl ester
555. The peptide according to item 434, wherein said uncommon amino acid is Naphthylalanine
556. The peptide according to item 434, wherein said uncommon amino acid is Nipecotic acid
557. The peptide according to item 434, wherein said uncommon amino acid is Nitrophenylalanine
558. The peptide according to item 434, wherein said uncommon amino acid is Norleucine
559. The peptide according to item 434, wherein said uncommon amino acid is Norvaline
560. The peptide according to item 434, wherein said uncommon amino acid is Octahydroindolecarboxylic acid
561. The peptide according to item 434, wherein said uncommon amino acid is ornithine
562. The peptide according to item 434, wherein said uncommon amino acid is Penicillamine
563. The peptide according to item 434, wherein said uncommon amino acid is Phenylglycine
564. The peptide according to item 434, wherein said uncommon amino acid is phosphocysteine
565. The peptide according to item 434, wherein said uncommon amino acid is phosphohistidine
566. The peptide according to item 434, wherein said uncommon amino acid is phosphoserine
567. The peptide according to item 434, wherein said uncommon amino acid is phosphothreonine
568. The peptide according to item 434, wherein said uncommon amino acid is phosphotyrosine
569. The peptide according to item 434, wherein said uncommon amino acid is phosphoarginine
570. The peptide according to item 434, wherein said uncommon amino acid is (phospho-5'-adenosine)-tyrosine
571. The peptide according to item 434, wherein said uncommon amino acid is phosphopantetheine-serine
572. The peptide according to item 434, wherein said uncommon amino acid is (phospho-5'-RNA)-serine
573. The peptide according to item 434, wherein said uncommon amino acid is (phospho-5'-adenosine)-lysine
574. The peptide according to item 434, wherein said uncommon amino acid is (phospho-5'-guanosine)-lysine
575. The peptide according to item 434, wherein said uncommon amino acid is (phospho-5'-DNA)-serine
576. The peptide according to item 434, wherein said uncommon amino acid is (phospho-5'-RNA)-tyrosine
577. The peptide according to item 434, wherein said uncommon amino acid is (phospho-5'-adenosine)-threonine
578. The peptide according to item 434, wherein said uncommon amino acid is (phospho-5'-DNA)-tyrosine
579. The peptide according to item 434, wherein said uncommon amino acid is (phospho-5'-DNA)-threonine
580. The peptide according to item 434, wherein said uncommon amino acid is (phospho-5'-uridine)-tyrosine 581. The peptide according to item 434, wherein said uncommon amino acid is 4-Phosphonomethylphenylalanine
582. The peptide according to item 434, wherein said uncommon amino acid is palmitoylcysteine
583. The peptide according to item 434, wherein said uncommon amino acid is palmitoyllysine
584. The peptide according to item 434, wherein said uncommon amino acid is palmitoylthreonine
585. The peptide according to item 434, wherein said uncommon amino acid is palmitoylserine
586. The peptide according to item 434, wherein said uncommon amino acid is palmitoylcysteine
587. The peptide according to item 434, wherein said uncommon amino acid is phycoerythrobilin-bis-cysteine
588. The peptide according to item 434, wherein said uncommon amino acid is phycourobilin-bis-cysteine
589. The peptide according to item 434, wherein said uncommon amino acid is pyrrolidone-5-carboxylic acid
590. The peptide according to item 434, wherein said uncommon amino acid is Pipericolic Acid
591. The peptide according to item 434, wherein said uncommon amino acid is Propargylglycine
592. The peptide according to item 434, wherein said uncommon amino acid is Pyridinylalanine
593. The peptide according to item 434, wherein said uncommon amino acid is pyroglutamic acid
594. The peptide according to item 434, wherein said uncommon amino acid is Sarcosine
595. The peptide according to item 434, wherein said uncommon amino acid is Tert-Leucine
596. The peptide according to item 434, wherein said uncommon amino acid is Tetrahydoisoquinoline-3-carboxylic acid
597. The peptide according to item 434, wherein said uncommon amino acid is Thiazolidinecarboxylic acid
598. The peptide according to item 434, wherein said uncommon amino acid is Thyronine
599. The peptide according to item 434, wherein said uncommon amino acid is selenocysteine
600. The peptide according to item 434, wherein said uncommon amino acid is selenomethionine
601. The peptide according to item 434, wherein said uncommon amino acid is erythro-beta-hydroxyasparagine
602. The peptide according to item 434, wherein said uncommon amino acid is erythro-beta-hydroxyaspartic acid
603. The peptide according to item 434, wherein said uncommon amino acid is gamma-carboxyglutamic acid
604. The peptide according to item 434, wherein said uncommon amino acid is aspartic 4-phosphoric anhydride
605. The peptide according to item 434, wherein said uncommon amino acid is 2'-[3-carboxamido-3-(trimethylammonio)propyl]-histidine
606. The peptide according to item 434, wherein said uncommon amino acid is glucuronoylglycine
607. The peptide according to item 434, wherein said uncommon amino acid is geranylgeranylcysteine
608. The peptide according to item 434, wherein said uncommon amino acid is myristoylglycine
609. The peptide according to item 434, wherein said uncommon amino acid is myristoyllysine
610. The peptide according to item 434, wherein said uncommon amino acid is cysteine methyl disulfide
611. The peptide according to item 434, wherein said uncommon amino acid is diacylglycerolcysteine
612. The peptide according to item 434, wherein said uncommon amino acid is isoglutamylcysteine
613. The peptide according to item 434, wherein said uncommon amino acid is cysteinylhistidine
614. The peptide according to item 434, wherein said uncommon amino acid is lanthionine
615. The peptide according to item 434, wherein said uncommon amino acid is mesolanthionine
616. The peptide according to item 434, wherein said uncommon amino acid is methyllanthionine
617. The peptide according to item 434, wherein said uncommon amino acid is cysteinyltyrosine
618. The peptide according to item 434, wherein said uncommon amino acid is carboxylysine
619. The peptide according to item 434, wherein said uncommon amino acid is carboxyethyllysine
620. The peptide according to item 434, wherein said uncommon amino acid is (4-amino-2-hydroxybutyl)-lysine
621. The peptide according to item 434, wherein said uncommon amino acid is biotinyllysine
622. The peptide according to item 434, wherein said uncommon amino acid is lipoyllysine
623. The peptide according to item 434, wherein said uncommon amino acid is pyridoxal phosphate-lysine
624. The peptide according to item 434, wherein said uncommon amino acid is retinal-lysine
625. The peptide according to item 434, wherein said uncommon amino acid is allysine
626. The peptide according to item 434, wherein said uncommon amino acid is lysinoalanine
627. The peptide according to item 434, wherein said uncommon amino acid is isoglutamyllysine
628. The peptide according to item 434, wherein said uncommon amino acid is glycyllysine
629. The peptide according to item 434, wherein said uncommon amino acid is isoaspartylglycine
630. The peptide according to item 434, wherein said uncommon amino acid is pyruvic acid
631. The peptide according to item 434, wherein said uncommon amino acid is phenyllactic acid
632. The peptide according to item 434, wherein said uncommon amino acid is oxobutanoic acid
633. The peptide according to item 434, wherein said uncommon amino acid is succinyltryptophan
634. The peptide according to item 434, wherein said uncommon amino acid is phycocyanobilincysteine
635. The peptide according to item 434, wherein said uncommon amino acid is phycoerythrobilincysteine
636. The peptide according to item 434, wherein said uncommon amino acid is phytochromobilincysteine
637. The peptide according to item 434, wherein said uncommon amino acid is heme-bis-cysteine
638. The peptide according to item 434, wherein said uncommon amino acid is heme-cysteine
639. The peptide according to item 434, wherein said uncommon amino acid is tetrakis-cysteinyl iron
640. The peptide according to item 434, wherein said uncommon amino acid is tetrakis-cysteinyl diiron disulfide
641. The peptide according to item 434, wherein said uncommon amino acid is tris-cysteinyl triiron trisulfide 642. The peptide according to item 434, wherein said uncommon amino acid is tris-cysteinyl triiron tetrasulfide
643. The peptide according to item 434, wherein said uncommon amino acid is tetrakis-cysteinyl tetrairon tetrasulfide
644. The peptide according to item 434, wherein said uncommon amino acid is cysteinyl homocitryl molybdenum-heptairon-nonasulfide
645. The peptide according to item 434, wherein said uncommon amino acid is cysteinyl molybdopterin
646. The peptide according to item 434, wherein said uncommon amino acid is (8alpha-FAD)-cysteine
647. The peptide according to item 434, wherein said uncommon amino acid is (8alpha-FAD)-histidine
648. The peptide according to item 434, wherein said uncommon amino acid is (8alpha-FAD)-tyrosine
649. The peptide according to item 434, wherein said uncommon amino acid is dihydroxyphenylalanine
650. The peptide according to item 434, wherein said uncommon amino acid is topaquinone
651. The peptide according to item 434, wherein said uncommon amino acid is tryptophyl quinine
652. The peptide according to item 434, wherein said uncommon amino acid is (tryptophan)-tryptophyl quinone
653. The peptide according to item 434, wherein said uncommon amino acid is glycosylasparagine
654. The peptide according to item 434, wherein said uncommon amino acid is glycosylcysteine
655. The peptide according to item 434, wherein said uncommon amino acid is glycosylhydroxylysine
656. The peptide according to item 434, wherein said uncommon amino acid is glycosylserine
657. The peptide according to item 434, wherein said uncommon amino acid is glycosylthreonine
658. The peptide according to item 434, wherein said uncommon amino acid is glycosyltryptophan
659. The peptide according to item 434, wherein said uncommon amino acid is glycosyltyrosine
660. The peptide according to item 434, wherein said uncommon amino acid is asparaginyl-glycosylphosphatidylinositolethanolamine
661. The peptide according to item 434, wherein said uncommon amino acid is aspartyl-glycosylphosphatidylinositolethanolamine
662. The peptide according to item 434, wherein said uncommon amino acid is cysteinyl-glycosylphosphatidylinositolethanolamine
663. The peptide according to item 434, wherein said uncommon amino acid is glycyl-glycosylphosphatidylinositolethanolamine
664. The peptide according to item 434, wherein said uncommon amino acid is seryl-glycosylphosphatidylinositolethanolamine
665. The peptide according to item 434, wherein said uncommon amino acid is seryl-glycosylsphingolipidinositolethanolamine
666. The peptide according to item 434, wherein said uncommon amino acid is (phosphoribosyl dephosphocoenzyme A)-serine
667. The peptide according to item 434, wherein said uncommon amino acid is (ADP-ribosyl)-arginine
668. The peptide according to item 434, wherein said uncommon amino acid is (ADP-ribosyl)-cysteine
669. The peptide according to item 434, wherein said uncommon amino acid is glutamyl-glycerylphosphorylethanolamine
670. The peptide according to item 434, wherein said uncommon amino acid is sulfocysteine
671. The peptide according to item 434, wherein said uncommon amino acid is sulfotyrosine
672. The peptide according to item 434, wherein said uncommon amino acid is bromohistidine
673. The peptide according to item 434, wherein said uncommon amino acid is bromophenylalanine
674. The peptide according to item 434, wherein said uncommon amino acid is triiodothyronine
675. The peptide according to item 434, wherein said uncommon amino acid is thyroxine
676. The peptide according to item 434, wherein said uncommon amino acid is bromotryptophan
677. The peptide according to item 434, wherein said uncommon amino acid is dehydroalanine
678. The peptide according to item 434, wherein said uncommon amino acid is dehydrobutyrine
679. The peptide according to item 434, wherein said uncommon amino acid is dehydrotyrosine
680. The peptide according to item 434, wherein said uncommon amino acid is seryl-imidazolinone glycine
681. The peptide according to item 434, wherein said uncommon amino acid is oxoalanine
682. The peptide according to item 434, wherein said uncommon amino acid is alanyl-imidazolinone glycine
683. The peptide according to item 434, wherein said uncommon amino acid is allo-isoleucine
684. The peptide according to item 434, wherein said uncommon amino acid is isoglutamyl-polyglycine
685. The peptide according to item 434, wherein said uncommon amino acid is isoglutamyl-polyglutamic acid
686. The peptide according to item 434, wherein said uncommon amino acid is aminovinyl-cysteine
687. The peptide according to item 434, wherein said uncommon amino acid is (aminovinyl)-methyl-cysteine
688. The peptide according to item 434, wherein said uncommon amino acid is cysteine sulfenic acid
689. The peptide according to item 434, wherein said uncommon amino acid is glycyl-cysteine
690. The peptide according to item 434, wherein said uncommon amino acid is hydroxycinnamyl-cysteine
691. The peptide according to item 434, wherein said uncommon amino acid is chondroitin sulfate glucuronyl-galactosyl-galactosyl-xylosyl-serine
692. The peptide according to item 434, wherein said uncommon amino acid is dermatan sulfate glucuronyl-galactosyl-galactosyl-xylosyl-serine
693. The peptide according to item 434, wherein said uncommon amino acid is heparan sulfate glucuronyl-galactosyl-galactosyl-xylosyl-serine
694. The peptide according to item 434, wherein said uncommon amino acid is glycosyl-hydroxyproline
695. The peptide according to item 434, wherein said uncommon amino acid is hydroxy-arginine
696. The peptide according to item 434, wherein said uncommon amino acid is isoaspartyl-cysteine
697. The peptide according to item 434, wherein said uncommon amino acid is alpha-mannosyl-tryptophan
698. The peptide according to item 434, wherein said uncommon amino acid is mureinyl-lysine 699. The peptide according to item 434, wherein said uncommon amino acid is chondroitin sulfate-aspartic acid ester
700. The peptide according to item 434, wherein said uncommon amino acid is (6-FMN)-cysteine
701. The peptide according to item 434, wherein said uncommon amino acid is diphytanylglycerol diether-cysteine
702. The peptide according to item 434, wherein said uncommon amino acid is bis-cysteinyl bis-histidino diiron disulfide
703. The peptide according to item 434, wherein said uncommon amino acid is hexakis-cysteinyl hexairon hexasulfide
704. The peptide according to item 434, wherein said uncommon amino acid is cysteine glutathione disulfide
705. The peptide according to item 434, wherein said uncommon amino acid is nitrosyl-cysteine
706. The peptide according to item 434, wherein said uncommon amino acid is (ADP-ribosyl)-asparagine
707. The peptide according to item 434, wherein said uncommon amino acid is beta-methylthioaspartic acid
708. The peptide according to item 434, wherein said uncommon amino acid is (lysine)-topaquinone
709. The peptide according to item 434, wherein said uncommon amino acid is hydroxymethyl-asparagine
710. The peptide according to item 434, wherein said uncommon amino acid is (ADP-ribosyl)-serine
711. The peptide according to item 434, wherein said uncommon amino acid is cysteine oxazolecarboxylic acid
712. The peptide according to item 434, wherein said uncommon amino acid is cysteine oxazolinecarboxylic acid
713. The peptide according to item 434, wherein said uncommon amino acid is glycine oxazolecarboxylic acid
714. The peptide according to item 434, wherein said uncommon amino acid is glycine thiazolecarboxylic acid
715. The peptide according to item 434, wherein said uncommon amino acid is serine thiazolecarboxylic acid
716. The peptide according to item 434, wherein said uncommon amino acid is phenyalanine thiazolecarboxylic acid
717. The peptide according to item 434, wherein said uncommon amino acid is cysteine thiazolecarboxylic acid
718. The peptide according to item 434, wherein said uncommon amino acid is lysine thiazolecarboxylic acid
719. The peptide according to item 434, wherein said uncommon amino acid is keratan sulfate glucuronyl-galactosyl-galactosyl-xylosyl-threonine
720. The peptide according to item 434, wherein said uncommon amino acid is selenocysteinyl molybdopterin guanine dinucleotide
721. The peptide according to item 434, wherein said uncommon amino acid is histidyl-tyrosine
722. The peptide according to item 434, wherein said uncommon amino acid is methionine sulfone
723. The peptide according to item 434, wherein said uncommon amino acid is dipyrrolylmethanemethyl-cysteine
724. The peptide according to item 434, wherein said uncommon amino acid is glutamyl-tyrosine
725. The peptide according to item 434, wherein said uncommon amino acid is glutamyl-poly-glutamic acid
726. The peptide according to item 434, wherein said uncommon amino acid is cysteine sulfinic acid
727. The peptide according to item 434, wherein said uncommon amino acid is trihydroxyphenylalanine
728. The peptide according to item 434, wherein said uncommon amino acid is (sn-1-glycerophosphoryl)-serine
729. The peptide according to item 434, wherein said uncommon amino acid is thioglycine
730. The peptide according to item 434, wherein said uncommon amino acid is heme P460-bis-cysteine-tyrosine
731. The peptide according to item 434, wherein said uncommon amino acid is tris-cysteinyl-cysteine persulfido-bis-glutamato-histidino tetrairon disulfide tri-oxide
732. The peptide according to item 434, wherein said uncommon amino acid is cysteine persulfide
733. The peptide according to item 434, wherein said uncommon amino acid is Lactic acid (2-hydroxypropanoic acid)
734. The peptide according to any of items 434 to 733, wherein said uncommon amino acid is the L-enantiomer
735. The peptide according to any of items 434 to 733, wherein said uncommon amino acid is the D-enantiomer The present invention is in one embodiment characterized by the items listed herein below in the 'second set of items'.

Second Set of Items:

1. A composition for vaccination and/or immune monitoring of a vaccine response comprising one or more pharmamers.
2. The composition according to item 1, wherein the one or more phamamers comprises one or more MHC multimers.
3. The composition according to item 2, wherein the one or more MHC multimers comprises a MHC multimer comprising (a-b-P)$_n$, wherein n>1,
wherein a and b together form a functional MHC protein capable of binding the peptide P, when P is present
wherein (a-b-P) is the MHC-peptide complex formed when the peptide P binds to the functional MHC protein,
wherein each MHC peptide complex is associated with one or more multimerization domains.
4. The composition according to item 3, wherein the association is a covalent linkage so that one or more of the n MHC-peptide complexes is covalently linked to the one or more multimerization domains.
5. The composition according to item 3, wherein the association is a non-covalent association so that one or more of the n MHC-peptide complexes is non-covalently associated with the one or more multimerization domains.
6. The composition according to item 3, wherein the one or more multimerization domains comprises one or more scaffolds.
7. The composition according to item 3, wherein the one or more multimerization domains comprises one or more carriers.
8. The composition according to item 3, wherein the one or more multimerization domains comprises at least one scaffold and at least one carrier.
9. The composition according to item 3, wherein the one or more multimerization domains comprise one or more optionally substituted organic molecules.
10. The composition according to item 9, wherein the optionally substituted organic molecule comprises one or more functionalized cyclic structures.

11. The composition according to item 10, wherein the one or more functionalized cyclic structures comprises one or more benzene rings.

12. The composition according to item 9, wherein the optionally substituted organic molecule comprises a scaffold molecule comprising at least three reactive groups, or at least three sites suitable for non-covalent attachment.

13. The composition according to item 3, wherein the one or more multimerization domains comprises one or more biological cells, such as antigen presenting cells or dendritic cells or cells transfected with one or more genes encoding MHC molecules.

14. The composition according to item 3, wherein the one or more multimerization domains comprises one or more membranes.

15. The composition according to item 14, wherein the one or more membranes comprises liposomes or micelles.

16. The composition according to item 3, wherein the one or more multimerization domains comprises one or more polymers.

17. The composition according to item 16, wherein the one or more polymers are selected from the group consisting of polysaccharides.

18. The composition according to item 17, wherein the polysaccharide comprises one or more dextran moieties.

19. The composition according to item 3, wherein the one or more multimerization domains comprises one or more entities selected from the group consisting of an IgG domain, a coiled-coil polypeptide structure, a DNA duplex, a nucleic acid duplex, PNA-PNA, PNA-DNA, DNA-RNA, streptavidin and avidin.

20. The composition according to item 3, wherein the one or more multimerization domains comprises an avidin, such as streptavidin.

21. The composition according to item 3, wherein the one or more multimerization domains comprises an antibody.

22. The composition according to item 21, wherein the antibody is selected from the group consisting of polyclonal antibody, monoclonal antibody, IgA, IgG, IgM, IgD, IgE, IgG1, IgG2, IgG3, IgG4, IgA1, IgA2, IgM1, IgM2, humanized antibody, humanized monoclonal antibody, chimeric antibody, mouse antibody, rat antibody, rabbit antibody, human antibody, camel antibody, sheep antibody, engineered human antibody, epitope-focused antibody, agonist antibody, antagonist antibody, neutralizing antibody, naturally-occurring antibody, isolated antibody, monovalent antibody, bispecific antibody, trispecific antibody, multispecific antibody, heteroconjugate antibody, immunoconjugates, immunoliposomes, labeled antibody, antibody fragment, domain antibody, nanobody, minibody, maxibody, diabody, fusion antibody.

23. The composition according to item 3, wherein the MHC multimer comprises one or more small organic scaffold molecules.

24. The composition according to item 3, wherein the MHC multimer comprises one or more further polypeptides in addition to a and b.

25. The composition according to item 3, wherein the MHC multimer comprises one or more protein complexes.

26. The composition according to item 3, wherein the MHC multimer comprises one or more beads.

27. The composition according to item 3, wherein the multimerization domain comprises one or more compounds selected from the group consisting of agarose, sepharose, resin beads, glass beads, pore-glass beads, glass particles coated with a hydrophobic polymer, chitosan-coated beads, SH beads, latex beads, spherical latex beads, allele-type beads, SPA bead, PEG-based resins, PEG-coated bead, PEG-encapsulated bead, polystyrene beads, magnetic polystyrene beads, glutathione agarose beads, magnetic bead, paramagnetic beads, protein A and/or protein G sepharose beads, activated carboxylic acid bead, macroscopic beads, microscopic beads, insoluble resin beads, silica-based resins, cellulosic resins, cross-linked agarose beads, polystyrene beads, cross-linked polyacrylamide resins, beads with iron cores, metal beads, dynabeads, Polymethylmethacrylate beads activated with NHS, streptavidin-agarose beads, polypropylene, polyethylene, dextran, nylon, amylases, natural and modified celluloses, nitrocellulose, polyacrylamides, gabbros, magnetite, polymers, oligomers, non-repeating moieties, polyethylene glycol (PEG), monomethoxy-PEG, mono-($C_1$-$C_{10}$)alkoxy-PEG, aryloxy-PEG, poly-(N-vinyl pyrrolidone)PEG, tresyl monomethoxy PEG, PEG propionaldehyde, bis-succinimidyl carbonate PEG, polystyrene bead crosslinked with divinylbenzene, propylene glycol homopolymers, a polypropylene oxide/ethylene oxide co-polymer, polyoxyethylated polyols (e.g., glycerol), polyvinyl alcohol, dextran, aminodextran, carbohydrate-based polymers, cross-linked dextran beads, polysaccharide beads, polycarbamate beads, divinyl sulfone activated polysaccharide, polystyrene beads that have been functionalized with tosyl-activated esters, magnetic polystyrene beads functionalized with tosyl-activated esters, streptavidin beads, streptaivdin-monomer coated beads, streptaivdin-tetramer coated beads, Streptavidin Coated Compel Magnetic beads, avidin coated beads, dextramer coated beads, divinyl sulfone-activated dextran, Carboxylate-modified bead, amine-modified beads, antibody coated beads, cellulose beads, grafted co-poly beads, poly-acrylamide beads, dimethylacrylamide beads optionally crosslinked with N—N'-bis-acryloylethylenediamine, hollow fiber membranes, fluorescent beads, collagen-agarose beads, gelatin beads, collagen-gelatin beads, collagen-fibronectin-gelatin beads, collagen beads, chitosan beads, collagen-chitosan beads, protein-based beads, hydrogel beads, hemicellulose, alkyl cellulose, hydroxyalkyl cellulose, carboxymethylcellulose, sulfoethyl-cellulose, starch, xylan, amylopectine, chondroitin, hyarulonate, heparin, guar, xanthan, mannan, galactomannan, chitin and chitosan.

28. The composition according to item 3, wherein the one or more multimerization domains comprises a dimerization domain.

29. The composition according to item 3, wherein the one or more multimerization domains comprises a trimerization domain.

30. The composition according to item 3, wherein the one or more multimerization domains comprises a tetramerization domain.

31. The composition according to item 3, wherein the one or more multimerization domains comprises a pentamerization domain.

32. The composition according to item 31, wherein the pentamerization domain comprises a coiled-coil polypeptide structure.

33. The composition according to item 3, wherein the one or more multimerization domains comprises a hexamerization domain.

34. The composition according to item 33, wherein the hexamerization domain comprises three IgG domains.

35. The composition according to item 3, wherein the one or more multimerization domains comprises a polymer structure to which is attached one or more scaffolds.

36. The composition according to item 35, wherein the polymer structure comprises a polysaccharide.

37. The composition according to item 36, wherein the polysaccharide comprises one or more dextran moieties.
38. The composition according to item 3, wherein the one or more multimerization domains comprises a polyamide and/or a polyethylene glycol and/or a polysaccharide and/or a sepharose.
39. The composition according to item 3, wherein the one or more multimerization domains comprises a carboxy methyl dextran and/or a dextran polyaldehyde and/or a carboxymethyl dextran lactone and/or a cyclodextrin.
40. The composition according to item 3, wherein the one or more multimerization domains have a molecular weight of less than 1,000 Da.
41. The composition according to item 3, wherein the one or more multimerization domains have a molecular weight of from 1,000 Da to preferably less than 10,000 Da.
42. The composition according to item 3, wherein the one or more multimerization domains have a molecular weight of from 10,000 Da to preferably less than 100,000 Da.
43. The composition according to item 3, wherein the one or more multimerization domains have a molecular weight of from 100,000 Da to preferably less than 1,000,000 Da.
44. The composition according to item 3, wherein the one or more multimerization domains have a molecular weight of more than 1,000,000 Da.
45. The composition according to item 3, wherein the one or more multimerization domains have a molecular weight of from 50,000 Da to preferably less than 1,000,000 Da, such as from 50,000 Da to 980,000; for example from 50,000 Da to 960,000; such as from 50,000 Da to 940,000; for example from 50,000 Da to 920,000; such as from 50,000 Da to 900,000; for example from 50,000 Da to 880,000; such as from 50,000 Da to 860,000; for example from 50,000 Da to 840,000; such as from 50,000 Da to 820,000; for example from 50,000 Da to 800,000; such as from 50,000 Da to 780,000; for example from 50,000 Da to 760,000; such as from 50,000 Da to 740,000; for example from 50,000 Da to 720,000; such as from 50,000 Da to 700,000; for example from 50,000 Da to 680,000; such as from 50,000 Da to 660,000; for example from 50,000 Da to 640,000; such as from 50,000 Da to 620,000; for example from 50,000 Da to 600,000; such as from 50,000 Da to 580,000; for example from 50,000 Da to 560,000; such as from 50,000 Da to 540,000; for example from 50,000 Da to 520,000; such as from 50,000 Da to 500,000; for example from 50,000 Da to 480,000; such as from 50,000 Da to 460,000; for example from 50,000 Da to 440,000; such as from 50,000 Da to 420,000; for example from 50,000 Da to 400,000; such as from 50,000 Da to 380,000; for example from 50,000 Da to 360,000; such as from 50,000 Da to 340,000; for example from 50,000 Da to 320,000; such as from 50,000 Da to 300,000; for example from 50,000 Da to 280,000; such as from 50,000 Da to 260,000; for example from 50,000 Da to 240,000; such as from 50,000 Da to 220,000; for example from 50,000 Da to 200,000; such as from 50,000 Da to 180,000; for example from 50,000 Da to 160,000; such as from 50,000 Da to 140,000; for example from 50,000 Da to 120,000; such as from 50,000 Da to 100,000; for example from 50,000 Da to 80,000; such as from 50,000 Da to 60,000; for example from 100,000 Da to 1,000,000; such as from 100,000 Da to 980,000; for example from 100,000 Da to 960,000; such as from 100,000 Da to 940,000; for example from 100,000 Da to 920,000; such as from 100,000 Da to 900,000; for example from 100,000 Da to 880,000; such as from 100,000 Da to 860,000; for example from 100,000 Da to 840,000; such as from 100,000 Da to 820,000; for example from 100,000 Da to 800,000; such as from 100,000 Da to 780,000; for example from 100,000 Da to 760,000; such as from 100,000 Da to 740,000; for example from 100,000 Da to 720,000; such as from 100,000 Da to 700,000; for example from 100,000 Da to 680,000; such as from 100,000 Da to 660,000; for example from 100,000 Da to 640,000; such as from 100,000 Da to 620,000; for example from 100,000 Da to 600,000; such as from 100,000 Da to 580,000; for example from 100,000 Da to 560,000; such as from 100,000 Da to 540,000; for example from 100,000 Da to 520,000; such as from 100,000 Da to 500,000; for example from 100,000 Da to 480,000; such as from 100,000 Da to 460,000; for example from 100,000 Da to 440,000; such as from 100,000 Da to 420,000; for example from 100,000 Da to 400,000; such as from 100,000 Da to 380,000; for example from 100,000 Da to 360,000; such as from 100,000 Da to 340,000; for example from 100,000 Da to 320,000; such as from 100,000 Da to 300,000; for example from 100,000 Da to 280,000; such as from 100,000 Da to 260,000; for example from 100,000 Da to 240,000; such as from 100,000 Da to 220,000; for example from 100,000 Da to 200,000; such as from 100,000 Da to 180,000; for example from 100,000 Da to 160,000; such as from 100,000 Da to 140,000; for example from 100,000 Da to 120,000; such as from 150,000 Da to 1,000,000; for example from 150,000 Da to 960,000; such as from 150,000 Da to 940,000; for example from 150,000 Da to 920,000; such as from 150,000 Da to 900,000; for example from 150,000 Da to 880,000; such as from 150,000 Da to 860,000; for example from 150,000 Da to 840,000; such as from 150,000 Da to 820,000; for example from 150,000 Da to 800,000; such as from 150,000 Da to 780,000; for example from 150,000 Da to 760,000; such as from 150,000 Da to 740,000; for example from 150,000 Da to 720,000; such as from 150,000 Da to 700,000; for example from 150,000 Da to 680,000; such as from 150,000 Da to 660,000; for example from 150,000 Da to 640,000; such as from 150,000 Da to 620,000; for example from 150,000 Da to 600,000; such as from 150,000 Da to 580,000; for example from 150,000 Da to 560,000; such as from 150,000 Da to 540,000; for example from 150,000 Da to 520,000; such as from 150,000 Da to 500,000; for example from 150,000 Da to 480,000; such as from 150,000 Da to 460,000; for example from 150,000 Da to 440,000; such as from 150,000 Da to 420,000; for example from 150,000 Da to 400,000; such as from 150,000 Da to 380,000; for example from 150,000 Da to 360,000; such as from 150,000 Da to 340,000; for example from 150,000 Da to 320,000; such as from 150,000 Da to 300,000; for example from 150,000 Da to 280,000; such as from 150,000 Da to 260,000; for example from 150,000 Da to 240,000; such as from 150,000 Da to 220,000; for example from 150,000 Da to 200,000; such as from 150,000 Da to 180,000; for example from 150,000 Da to 160,000.
46. The composition according to item 3, wherein n is 2.
47. The composition according to item 3, wherein n is 3.
48. The composition according to item 3, wherein n is 4.
49. The composition according to item 3, wherein n is 5.
50. The composition according to item 3, wherein n is 6.
51. The composition according to item 3, wherein n is 7.
52. The composition according to item 3, wherein n is 8,9,10,11 or 12.
53. The composition according to item 3, wherein n<12.
54. The composition according to item 3, wherein 1<n<100.
55. The composition according to item 3, wherein 1<n<1000.
56. The composition according to item 3, wherein 1<n.
57. The composition according to item 3, wherein n is billions or trillions or higher.

58. The composition according to item 3, wherein n<1,000,000,000.

59. The composition according to item 3, wherein n<1,000,000,000,000,000.

60. The composition according to item 3, wherein n (the total number of MHC molecules of the construct) is in the range from 100 MHC molecules to 1,000,000 MHC molecules such as from 100 to 1,000 MHC molecules, for example from 1,000 to 5,000 MHC molecules, such as from 5,000 to 10,000 MHC molecules, for example from 10,000 to 20,000 MHC molecules, such as from 20,000 to 30,000 MHC molecules, for example from 30,000 to 40,000 MHC molecules, such as from 40,000 to 50,000 MHC molecules, for example from 50,000 to 60,000 MHC molecules, such as from 60,000 to 70,000 MHC molecules, for example from 70,000 to 80,000 MHC molecules, such as from 80,000 to 90,000 MHC molecules, for example from 90,000 to 100,000 MHC molecules, such as from 100,000 to 200,000 MHC molecules, for example from 200,000 to 300,000 MHC molecules, such as from 300,000 to 400,000 MHC molecules, for example from 400,000 to 500,000 MHC molecules, such as from 500,000 to 600,000 MHC molecules, for example from 600,000 to 700,000 MHC molecules, such as from 700,000 to 800,000 MHC molecules, for example from 800,000 to 900,000 MHC molecules, such as from 900,000 to 1,000,000 MHC molecules.

61. The vaccine composition according to any of items 3 to 60, wherein n is selected from the group of integers consisting of 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41,42, 43, 44, 45, 46, 47, 48, 50, 55, 60, 65, 70, 75, 80, 85, 90, 95, 100, 110, 120, 130, 140, 150, 160, 170, 180, 190, 200, 250, 300, 350, 400, 450, 500, 550, 600, 650, 700, 750, 800, 850, 900 and 1000.

62. The vaccine composition according to any of items 3 to 60, wherein n has a value of from 1 to 1000, for example from 1 to 10, such as from 10 to 20, for example from 20 to 30, such as from 30 to 40, for example from 40 to 50, such as from 50 to 60, for example from 60 to 70, such as from 70 to 80, for example from 80 to 90, such as from 90 to 100, for example from 100 to 120, such as from 120 to 140, for example from 140 to 160, such as from 160 to 180, for example from 180 to 200, such as from 200 to 250, for example from 250 to 300, such as from 300 to 350, for example from 350 to 400, such as from 400 to 450, for example from 450 to 500, such as from 500 to 550, for example from 550 to 600, such as from 600 to 650, for example from 650 to 700, such as from 700 to 750, for example from 750 to 800, such as from 800 to 900, for example from 900 to 950, such as from 950 to 1000.

63. The composition according to item 3, wherein a and/or b and/or P is of human origin.

64. The composition according to item 3, wherein a and/or b and/or P is of mouse origin.

65. The composition according to item 3, wherein a and/or b and/or P is of primate origin.

66. The composition according to item 3, wherein a and/or b and/or P is of chimpansee origin.

67. The composition according to item 3, wherein a and/or b and/or P is of gorilla origin.

68. The composition according to item 3, wherein a and/or b and/or P is of orangutan origin.

69. The composition according to item 3, wherein a and/or b and/or P is of monkey origin.

70. The composition according to item 3, wherein a and/or b and/or P is of Macaque origin.

71. The composition according to item 3, wherein a and/or b and/or P is of porcine (swine/pig) origin.

72. The composition according to item 3, wherein a and/or b and/or P is of bovine (cattle/antilopes) origin.

73. The composition according to item 3, wherein a and/or b and/or P is of equine (horse) origin.

74. The composition according to item 3, wherein a and/or b and/or P is of Camelides (camels) origin.

75. The composition according to item 3, wherein a and/or b and/or P is of ruminant origin.

76. The composition according to item 3, wherein a and/or b and/or P is of Canine (Dog) origin.

77. The composition according to item 3, wherein a and/or b and/or P is of Feline (Cat) origin.

78. The composition according to item 3, wherein a and/or b and/or P is of Bird origin.

79. The composition according to item 3, wherein a and/or b and/or P is of Chicken origin.

80. The composition according to item 3, wherein a and/or b and/or P is of Turkey origin.

81. The composition according to item 3, wherein a and/or b and/or P is of Fish origin.

82. The composition according to item 3, wherein a and/or b and/or P is of Reptile origin.

83. The composition according to item 3, wherein a and/or b and/or P is of Amphibian origin.

84. The composition according to item 3 to 83, wherein (a-b-P) is a class 1 MHC-peptide complex.

85. The composition according to item 3 to 83, wherein (a-b-P) is a class 2 MHC-peptide complex.

86. The composition according to item 3 to 85, wherein one or more labels are attached directly to the MHC multimer.

87. The composition according to item 3 to 85, wherein one or more labels are used for combinatorial use of labelling of the MHC multimer.

88. The composition according to item 3 to 85, wherein one or more labels are attached indirectly to the MHC multimer such as via one or more marker molecules carrying one or more labels.

89. The composition according to item 3 to 85, wherein one or more labels result in positive selection of that MHC multimer.

90. The composition according to item 3 to 85, wherein one or more labels result in negative selection of that MHC multimer.

91. The composition according to item 3 to 85 comprising one or more covalently attached labels.

92. The composition according to item 3 to 85 comprising one or more non-covalently attached labels.

93. The composition according to item 91, wherein the one or more labels is covalently attached to the polypeptide a.

94. The composition according to item 91, wherein the one or more labels is covalently attached to the polypeptide b.

95. The composition according to item 91, wherein the one or more labels is covalently attached to the peptide P.

96. The composition according to item 91, wherein the one or more labels is covalently attached to the one or more multimerization domains.

97. The composition according to item 91, wherein the one or more labels is covalently attached to $(a-b-P)_n$.

98. The composition according to item 92, wherein the one or more labels is non-covalently attached to the polypeptide a.

99. The composition according to item 92, wherein the one or more labels is non-covalently attached to the polypeptide b.

100. The composition according to item 92, wherein the one or more labels is non-covalently attached to P.
101. The composition according to item 92, wherein the one or more labels is non-covalently attached to the one or more multimerization domains.
102. The composition according to item 92, wherein the one or more labels is non-covalently attached to $(a-b-P)_n$.
103. The composition according to item 92, wherein the one or more labels is non-covalently attached to the antibody in the mutimerization domain.
104. The composition according to item 91, wherein the one or more labels is covalently attached to an antibody in the mutimerization domain.
105. The composition according to item 92, wherein the one or more labels is non-covalently attached to an aptamer in the mutimerization domain.
106. The composition according to item 91, wherein the one or more labels is covalently attached to an aptamer in the mutimerization domain.
107. The composition according to item 92, wherein the one or more labels is non-covalently attached to a molecule in the mutimerization domain.
108. The composition according to item 91, wherein the one or more labels is covalently attached to a molecule in the mutimerization domain.
109. The composition according to item 92, wherein the one or more labels is non-covalently attached to a protein in the mutimerization domain.
110. The composition according to item 91, wherein the one or more labels is covalently attached to a protein in the mutimerization domain.
111. The composition according to item 92, wherein the one or more labels is non-covalently attached to a sugar residue in the mutimerization domain.
112. The composition according to item 91, wherein the one or more labels is covalently attached to a sugar residue in the mutimerization domain.
113. The composition according to item 92, wherein the one or more labels is non-covalently attached to a DNA in the mutimerization domain.
114. The composition according to item 91, wherein the one or more labels is covalently attached to a DNA in the mutimerization domain.
115. The composition according to item 86 to 114, wherein the attachment is directly between reactive groups in the labelling molecule and reactive groups in the marker molecule.
116. The composition according to item 86 to 114, wherein the attachment is through a linker connecting labelling molecule and marker.
117. The composition according to item 86 to 116, wherein one label is used.
118. The MHC multimer according to any of the items 86 to 116, wherein more than one label is used.
119. The composition according to item 118, wherein the more than one label are all identical.
120. The composition according to item 118, wherein at least two labels are different.
121. The composition according to item 86 to 120, wherein the one or more labels is attached to $(a-b-P)_n$ via a streptavidin-biotin linkage.
122. The composition according to item 86 to 120, wherein the one or more labels is a fluorophore label.
123. The composition according to item 122, wherein the one or more fluorophore label are selected from the group of fluorescein isothiocyanate, rhodamine, phycoerythrin, phycocyanin, allophycocyanin, o-phthaldehyde and fluorescamine.
124. The composition according to item 122, wherein the one or more fluorophore label are selected from the group consisting of 2-(4'-maleimidylanilino)naphthalene-6-sulfonic acid, sodium salt.
125. The composition according to item 122, wherein the one or more fluorophore label are selected from the group consisting of 5-((((2-iodoacetyl)amino)ethyl)amino) naphthalene-1-sulfonic acid.
126. The composition according to item 122, wherein the one or more fluorophore label are selected from the group consisting of Pyrene-1-butanoic acid.
127. The composition according to item 122, wherein the one or more fluorophore label are selected from the group consisting of AlexaFluor 350 (7-amino-6-sulfonic acid-4-methyl coumarin-3-acetic acid.
128. The composition according to item 122, wherein the one or more fluorophore label are selected from the group consisting of AMCA (7-amino-4-methyl coumarin-3-acetic acid.
129. The composition according to item 122, wherein the one or more fluorophore label are selected from the group consisting of 7-hydroxy-4-methyl coumarin-3-acetic acid.
130. The composition according to item 122, wherein the one or more fluorophore label are selected from the group consisting of Marina Blue (6,8-difluoro-7-hydroxy-4-methyl coumarin-3-acetic acid.
131. The composition according to item 122, wherein the one or more fluorophore label are selected from the group consisting of 7-dimethylamino-coumarin-4-acetic acid.
132. The composition according to item 122, wherein the one or more fluorophore label are selected from the group consisting of Fluorescamin-N-butyl amine adduct.
133. The composition according to item 122, wherein the one or more fluorophore label are selected from the group consisting of 7-hydroxy-coumarine-3-carboxylic acid.
134. The composition according to item 122, wherein the one or more fluorophore label are selected from the group consisting of CascadeBlue (pyrene-trisulphonic acid acetyl azide.
135. The composition according to item 122, wherein the one or more fluorophore label are selected from the group consisting of Cascade Yellow.
136. The composition according to item 122, wherein the one or more fluorophore label are selected from the group consisting of Pacific Blue (6,8 difluoro-7-hydroxy coumarin-3-carboxylic acid.
137. The composition according to item 122, wherein the one or more fluorophore label are selected from the group consisting of 7-diethylamino-coumarin-3-carboxylic acid.
138. The composition according to item 122, wherein the one or more fluorophore label are selected from the group consisting of N-(((4-azidobenzoyl)amino)ethyl)-4-amino-3,6-disulfo-1,8-naphthalimide, dipotassium salt.
139. The composition according to item 122, wherein the one or more fluorophore label are selected from the group consisting of Alexa Fluor 430.
140. The composition according to item 122, wherein the one or more fluorophore label are selected from the group consisting of 3-perylenedodecanoic acid.
141. The composition according to item 122, wherein the one or more fluorophore label are selected from the group consisting of 8-hydroxypyrene-1,3,6-trisulfonic acid, trisodium salt.

142. The composition according to item 122, wherein the one or more fluorophore label are selected from the group consisting of 12-(N-(7-nitrobenz-2-oxa-1,3-diazol-4-yl)amino)dodecanoic acid.
143. The composition according to item 122, wherein the one or more fluorophore label are selected from the group consisting of N,N'-dimethyl-N-(iodoacetyl)-N'-(7-nitrobenz-2-oxa-1,3-diazol-4-yl)ethylenediamine.
144. The composition according to item 122, wherein the one or more fluorophore label are selected from the group consisting of Oregon Green 488 (difluoro carboxy fluorescein).
145. The composition according to item 122, wherein the one or more fluorophore label are selected from the group consisting of 5-iodoacetamidofluorescein.
146. The composition according to item 122, wherein the one or more fluorophore label are selected from the group consisting of propidium iodide-DNA adduct.
147. The composition according to item 122, wherein the one or more fluorophore label are selected from the group consisting of Carboxy fluorescein.
148. The composition according to any of items 86 to 120, wherein the one or more labels is a fluorescent label.
149. The composition according to item 148, wherein the one or more fluorescent label is a simple fluorescent label.
150. The composition according to item 149, wherein the one or more simple fluorescent label is selected from the group Fluor dyes, Pacific Blue™, Pacific Orange™, Cascade Yellow™.
151. The composition according to item 149, wherein the one or more simple fluorescent label is selected from the group AlexaFluor®(AF), AF405, AF488, AF500, AF514, AF532, AF546, AF555, AF568, AF594, AF610, AF633, AF635, AF647, AF680, AF700, AF710, AF750, AF800.
152. The composition according to item 149, wherein the one or more simple fluorescent label is selected from the group Quantum Dot based dyes, QDot® Nanocrystals (Invitrogen, MolecularProbs), Qdot®525, Qdot®565, Qdot®585, Qdot®605, Qdot®655, Qdot®705, Qdot®800.
153. The composition according to item 149, wherein the one or more simple fluorescent label is selected from the group DyLight™ Dyes (Pierce) (DL); DL549, DL649, DL680, DL800.
154. The composition according to item 149, wherein the one or more simple fluorescent label is selected from the group Fluorescein (Flu) or any derivate of that, such as FITC.
155. The composition according to item 149, wherein the one or more simple fluorescent label is selected from the group Cy-Dyes, Cy2, Cy3, Cy3.5, Cy5, Cy5.5, Cy7.
156. The composition according to item 149, wherein the one or more simple fluorescent label is selected from the group Fluorescent Proteins, RPE, PerCp, APC, Green fluorescent proteins; GFP and GFP derivated mutant proteins; BFP, CFP, YFP, DsRed, T1, Dimer2, mRFP1, MBanana, mOrange, dTomato, tdTomato, mTangerine, mStrawberry, mCherry.
157. The composition according to item 149, wherein the one or more simple fluorescent label is selected from the group Tandem dyes, RPE-Cy5, RPE-Cy5.5, RPE-Cy7, RPE-AlexaFluor® tandem conjugates; RPE-Alexa610, RPE-TxRed, APC-Aleca600, APC-Alexa610, APC-Alexa750, APC-Cy5, APC-Cy5.5.
158. The composition according to item 149, wherein the one or more simple fluorescent label is selected from the group multi fluorochrome assemblies, Multiple fluorochromes attached to a polymer molecule, such as a peptide/protein, Dextrane, polysaccharide, any combination of the fluorescent dyes involving in generation of FRET (Fluorescence resonance energy transfer) based techniques.
159. The composition according to item 149, wherein the one or more simple fluorescent label is selected from the group ionophors; ion chelating fluorescent props, props that change wavelength when binding a specific ion, such as Calcium, props that change intensity when binding to a specific ion, such as Calcium.
160. The composition according to any of items 86 to 120, wherein the one or more labels is capable of absorption of light.
161. The composition according to item 160, wherein the one or more labels capable of absorption of light is a chromophore.
162. The composition according to item 160, wherein the one or more labels capable of absorption of light is a dye.
163. The composition according to any of items 86 to 120, wherein the one or more labels is capable of emission of light after excitation.
164. The composition according to item 163, wherein the one or more labels capable of emission of light is one or more fluorochromes.
165. The composition according to item 164, wherein the one or more fluorochrome is selected from the AlexaFluor® (AF) family, which include AF®350, AF405, AF430, AF488, AF500, AF514, AF532, AF546, AF555, AF568, AF594, AF610, AF633, AF635, AF647, AF680, AF700, AF710, AF750 and AF800.
166. The composition according to item 164, wherein the one or more fluorochrome is selected from the Quantum Dot (Qdot®) based dye family, which include Qdot®525, Qdot®565, Qdot®585, Qdot®605, Qdot®655, Qdot®705, Qdot®800.
167. The composition according to item 164, wherein the one or more fluorochrome is selected from the DyLight™ Dyes (DL) family, which include DL549, DL649, DL680, DL800.
168. The composition according to item 164, wherein the one or more fluorochrome is selected from the family of Small fluorescing dyes, which include FITC, Pacific Blue™, Pacific Orange™, Cascade Yellow™, Marina Blue™, DSred, DSred-2, 7-AAD, TO-Pro-3.
169. The composition according to item 164, wherein the one or more fluorochrome is selected from the family of Cy-Dyes, which include Cy2, Cy3, Cy3.5, Cy5, Cy5.5, Cy7.
170. The composition according to item 164, wherein the one or more fluorochrome is selected from the family of Phycobili Proteins, which include R-Phycoerythrin (RPE), PerCP, Allophycocyanin (APC), B-Phycoerythrin, C-Phycocyanin.
171. The composition according to item 164, wherein the one or more fluorochrome is selected from the family of Fluorescent Proteins, which include (E)GFP and GFP ((enhanced) green fluorescent protein) derived mutant proteins; BFP, CFP, YFP, DsRed, T1, Dimer2, mRFP1, MBanana, mOrange, dTomato, tdTomato, mTangerine.
172. The composition according to item 164, wherein the one or more fluorochrome is selected from the family of Tandem dyes with RPE, which include RPE-Cy5, RPE-Cy5.5, RPE-Cy7, RPE-AlexaFluor® tandem conjugates; RPE-Alexa610, RPE-TxRed.
173. The composition according to item 164, wherein the one or more fluorochrome is selected from the family of Tandem dyes with APC, which include APC-Aleca600, APC-Alexa610, APC-Alexa750, APC-Cy5, APC-Cy5.5.

174. The composition according to item 164, wherein the one or more fluorochrome is selected from the family of Calcium dyes, which include Indo-1-$Ca^{2+}$ Indo-2-$Ca^{2+}$.
175. The composition according to any of items 86 to 120, wherein the one or more labels is capable of reflection of light.
176. The composition according to item 175, wherein the one or more labels capable of reflection of light comprises gold.
177. The composition according to item 175, wherein the one or more labels capable of reflection of light comprises plastic.
178. The composition according to item 175, wherein the one or more labels capable of reflection of light comprises glass.
179. The composition according to item 175, wherein the one or more labels capable of reflection of light comprises polystyrene.
180. The composition according to item 175, wherein the one or more labels capable of reflection of light comprises pollen.
181. The composition according to any of items 86 to 120, wherein the one or more labels is a chemiluminescent label.
182. The composition according to item 181, wherein the chemiluminescent labels is selected from the group luminol, isoluminol, theromatic acridinium ester, imidazole, acridinium salt and oxalate ester.
183. The composition according to any of items 86 to 120, wherein the one or more labels is a bioluminescent label.
184. The composition according to item 183, wherein the bioluminescent labels is selected from the group luciferin, luciferase and aequorin.
185. The composition according to any of items 86 to 120, wherein the one or more labels is a radioactive label.
186. The composition according to item 185, wherein the one or more radioactive labels is a radionuclide.
187. The composition according to item 185, wherein the one or more radioactive labels is an isotope.
188. The composition according to item 185, wherein the one or more radioactive labels comprises α rays.
189. The composition according to item 185, wherein the one or more radioactive labels comprises β rays.
190. The composition according to item 185, wherein the one or more radioactive labels comprises γ rays.
191. The composition according to any of items 86 to 120, wherein the one or more labels is detectable by NMR (nuclear magnetic resonance form paramagnetic molecules).
192. The composition according to any of items 86 to 120, wherein the one or more labels is an enzyme label.
193. The composition according to item 192, wherein the enzyme catalyze a reaction between chemicals in the near environment of the labeling molecules, producing a light signal (chemi-luminescence).
194. The composition according to item 192, wherein the enzyme catalyzes a reaction between chemicals in the near environment of the labeling molecules, resulting in precipitation of chromophor dyes.
195. The composition according to item 192, wherein the enzyme catalyzes a reaction between chemicals in the near environment of the labeling molecules, resulting in precipitates that can be detected by an additional layer of detection molecules.
196. The composition according to item 192, wherein the enzyme label is selected from the group peroxidases, malate dehydrogenase, staphylococcal nuclease, delta-5-steroid isomerase, yeast alcohol dehydrogenase, alpha-glycerophosphate, dehydrogenase, triose phosphate isomerase, horseradish peroxidase, alkaline phosphatase, asparaginase, glucose oxidase, beta-galactosidase, ribonuclease, urease, catalase, glucose-6-phosphate dehydrogenase, glucoamylase and acetylcholinesterase.
197. The composition according to item 192, wherein the enzyme label is horseradish peroxidase.
198. The composition according to item 192, wherein the enzyme label is horseradish peroxidase and the substrate is diaminobenzidine (DAB).
199. The composition according to item 192, wherein the enzyme label is horseradish peroxidase and the substrate is 3-amino-9-ethyl-carbazole (AEC+).
200. The composition according to item 192, wherein the enzyme label is horseradish peroxidase and the substrate is biotinyl tyramide.
201. The composition according to item 192, wherein the enzyme label is horseradish peroxidase and the substrate is fluorescein tyramide.
202. The composition according to item 192, wherein the enzyme label is alkaline phosphatise.
203. The composition according to item 192, wherein the enzyme label is alkaline phosphatase and the substrate is Fast red dye.
204. The composition according to any of items 86 to 120, wherein the one or more labels is a ionophore or chelating chemical compound binding to specific ions such as $Ca^{2+}$.
205. The composition according to any of items 86 to 120, wherein the one or more labels is a lanthanide.
206. The composition according to item 205, wherein the lanthanide comprises fluorescence.
207. The composition according to item 205, wherein the lanthanide comprises Phosphorescence.
208. The composition according to item 205, wherein the lanthanide is paramagnetic.
209. The composition according to any of items 86 to 120, wherein the one or more labels is a DNA fluorescing stain.
210. The composition according to item 209, wherein the DNA fluorescing stain is Propidium iodide.
211. The composition according to item 209, wherein the DNA fluorescing stain is Hoechst stain.
212. The composition according to item 209, wherein the DNA fluorescing stain is DAPI.
213. The composition according to item 209, wherein the DNA fluorescing stain is AMC.
214. The composition according to item 209, wherein the DNA fluorescing stain is DraQ5™.
215. The composition according to item 209, wherein the DNA fluorescing stain is Acridine orange.
216. The composition according to item 3, wherein the MHC-peptide complex (a-b-P) is attached to a multimerization domain comprising an avidin or streptavidin via a linkage comprising a biotin moiety.
217. The composition according to any of items 3 to 216, wherein P and/or a and/or b is chemically modified.
218. The composition according to any of items 3 to 216, wherein P and/or a and/or b is pegylated.
219. The composition according to any of items 3 to 216, wherein P and/or a and/or b is phosphorylated.
220. The composition according to any of items 3 to 216, wherein P and/or a and/or b is glycosylated.
221. The composition according to any of items 3 to 216, wherein one of the amino acid residues of the peptide P and/or a and/or b is substituted with another amino acid.
222. The composition according to any of items 3 to 216, wherein a and b are both full-length peptides.
223. The composition according to any of items 3 to 216, wherein a is a full-length peptide.

224. The composition according to any of items 3 to 216, wherein b is a full-length peptide.
225. The composition according to any of items 3 to 216, wherein a is truncated.
226. The composition according to any of items 3 to 216, wherein b is truncated.
227. The composition according to any of items 3 to 216, wherein a and b are both truncated.
228. The composition according to any of items 3 to 216, wherein a and b are covalently linked.
229. The composition according to any of items 3 to 216, wherein a and P are covalently linked.
230. The composition according to any of items 3 to 216, wherein b and P are covalently linked.
231. The composition according to any of items 3 to 216, wherein a, b and P are covalently linked.
232. The composition according to any of items 3 to 216, wherein a and b are non-covalently linked.
233. The composition according to any of items 3 to 216, wherein a and P are non-covalently linked.
234. The composition according to any of items 3 to 216, wherein b and P are non-covalently linked.
235. The composition according to any of items 3 to 216, wherein a, b and P are non-covalently linked.
236. The composition according to any of items 3 to 216, wherein a is not included in the (a-b-P) complex.
237. The composition according to any of items 3 to 216, wherein b is not included in the (a-b-P) complex.
238. The composition according to any of items 3 to 216, wherein P is not included in the (a-b-P) complex.
239. The composition according to any of items 3 to 216, wherein the MHC-peptide complex is linked to at least one of the one or more multimerization domains by a linker moiety.
240. The composition according to item 239, wherein the MHC-peptide complex is linked to at least one of the one or more multimerization domains by a covalent linker moiety.
241. The MHC multimer according to items 239 and 240, wherein the linkage of at least one of the one or more multimerization domains and at least one MHC-peptide complexes is formed by a binding entity X attached to, or being part of, at least one of the one or more multimerization domains, and a binding entity Y attached to, or being part of at least one of the MHC-peptide complexes.
242. The composition according to item 239 and 240, wherein the linker moiety linking at least one of the one or more multimerization domains and the MHC-peptide complex comprises the linker moiety XY, wherein the linker moiety XY results from a reaction of the moiety X comprising one or more reactive groups and the moiety Y comprising one or more reactive groups, wherein at least some of said reactive groups are capable of reacting with each other.
243. The composition according to item 242, wherein the moiety X comprises a nucleophilic group.
244. The composition according to item 243, wherein the nucleophilic group is selected from the group consisting of —NH$_2$, —OH, —SH, —NH—NH$_2$, —CN.
245. The composition according to item 242, wherein the moiety Y comprises an electrophilic group.
246. The composition according to item 245, wherein the electrophilic group is selected from the group consisting of CHO, COOH, CO, NHS-ester, tosyl activated ester, acidanhydride other activated esters.
247. The MHC multimer according to items 239 and 240, wherein at least one of the reactive groups on one of the moieties X and Y comprises a radical capable of reacting with a reactive group forming part of the other moiety.
248. The MHC multimer according to items 239 and 240, wherein X and Y comprises reactive groups natively associated with the one or more multimerization domains and/or the MHC-peptide complexes.
249. The MHC multimer according to items 239 and 240, wherein X and Y comprises reactive groups not natively associated with the one or more multimerization domains and/or the MHC-peptide complex.
250. The MHC multimer according to items 239 and 240, wherein the linker moiety forms a covalent link between at least one of the one or more multimerization domains and at least one of the MHC-peptide complexes.
251. The MHC multimer according to items 239 and 240, wherein the reactive groups of MHC-peptide complexes include amino acid side chains selected from the group —NH$_2$, —OH, —SH, and —NH—.
252. The MHC multimer according to items 239 and 240, wherein the reactive groups of multimerization domains include hydroxyls of polysaccharides such as dextrans.
253. The MHC multimer according to items 239 and 240, wherein the reactive groups of multimerization domains selected from the group amino acid side chains comprising —NH$_2$, —OH, —SH, and —NH— of polypeptides.
254. The MHC multimer according to items 239 and 240, wherein one of the polypeptides of the MHC-peptide complex is covlalently or non-covalently linked by a protein fusion to the multimerization domain.
255. The MHC multimer according to items 239 and 240, wherein one of the polypeptides of the MHC-peptide complex is linked by a protein fusion to the multimerization domain, wherein an acyl group and an amino group react to form an amide bond.
256. The composition according to item 3, wherein one of the polypeptides of the MHC-peptide complex is a 12M polypeptide.
257. The composition according to item 3, wherein one of the polypeptides of the MHC-peptide complex is a MHC I heavy chain polypeptide.
258. The composition according to item 3, wherein one of the polypeptides of the MHC-peptide complex is an antigenic peptide.
259. The composition according to item 3, wherein one of the polypeptides of the MHC-peptide complex is a MHC II α-chain polypeptide.
259. The composition according to item 3, wherein one of the polypeptides of the MHC-peptide complex is a MHC II β-chain polypeptide
260. The composition according to item 3, wherein one of the polypeptides of the MHC-peptide complex is linked by non-native reactive groups to the multimerization domain
261. The composition according to item 260, wherein the non-native reactive groups include reactive groups that are attached to the multimerization domain through association of a linker molecule comprising the reactive group.
262. The composition according to item 260, wherein the non-native reactive groups include reactive groups that are attached to the MHC-peptide complex through association of a linker molecule comprising the reactive group.
263. The composition according to item 18, wherein dextran is activated by reaction of the dextran hydroxyls with divinyl sulfon
264. The composition according to item 263, wherein dextran is activated by a multistep reaction that results in the decoration of the dextran with maleimide groups 265. The composition according to item 3, wherein the multimerization domain comprises one or more nucleophilic groups 266. The composition according to item 265, wherein the nucleophilic group is selected from the group —NH$_2$, —OH, —SH, —CN, —NH—NH$_2$ 267. The composition according to item 3, wherein the multimerization domain is selected from the group polysaccharides, polypeptides comprising e.g. lysine, serine, and cysteine.

268. The composition according to item 3, wherein the multimerization domain comprises one or more electrophilic groups.

269. The composition according to item 268, wherein the electrophilic group is selected from the group —COOH, —CHO, —CO, NHS-ester, tosyl-activated ester, and other activated esters, acid-anhydrides.

270. The composition according to item 3, wherein the multimerization domain is selected from the group of polypeptides comprising e.g. glutamate and aspartate, or vinyl sulfone activated dextran.

271. The composition according to item 3, wherein the multimerization domain comprises one or more radicals.

272. The composition according to item 3, wherein the multimerization domain comprises one or more conjugated double bonds.

273. The composition according to item 3, wherein the MHC-peptide complex comprises one or more nucleophilic groups.

274. The composition according to item 273, wherein the nucleophilic group is selected from the group —NH$_2$, —OH, —SH, —CN, —NH—NH$_2$.

275. The composition according to item 3, wherein the MHC-peptide complex comprises one or more electrophilic groups.

276. The composition according to item 275, wherein the electrophilic group is selected from the group —COOH, —CHO, —CO, NHS-ester, tosyl-activated ester, and other activated esters, acid-anhydrides.

277. The composition according to item 3, wherein the MHC-peptide complex comprises one or more radicals.

278. The composition according to item 3, wherein the MHC-peptide complex comprises one or more conjugated double bonds 279. The composition according to item 3, wherein the multimerization domain comprises one or more beads and one or more linker moieties.

280. The composition according to item 279, wherein the linker is a flexible linker.

281. The composition according to item 279, wherein the linker is a rigid linker.

282. The composition according to item 279, wherein the linker is a water-soluble linker.

283. The composition according to item 279, wherein the linker is a cleavable linker.

284. The composition according to item 283, wherein the cleavable linker is selected from linkers depicted in (FIG. 2) in PCT/DK2008/050167.

285. The composition according to item 283, wherein the cleavable linker is cleavable at physiological conditions 286. The MHC multimer according to item 3, wherein the MHC-peptide complex is linked to at least one of the one or more multimerization domains by a non-covalent linker moiety.

287. The composition according to item 286, wherein the non-covalent linkage comprises natural dimerization.

288. The composition according to item 287, wherein the natural dimerization comprises antigen-antibody pairs or coiled coil structures.

289. The composition according to item 287, wherein the natural dimerization comprises DNA-DNA interactions.

290. The composition according to item 286, wherein the non-covalent linkage comprises natural interactions.

291. The composition according to item 290, wherein the natural interaction comprises biotin and streptavidin.

292. The composition according to item 26, wherein the bead is coated with streptavidin monomers, which in turn are associated with biotinylated MHC complexes 293. The composition according to item 26, wherein the bead is coated with streptavidin tetramers each of which being independently associated with 0, 1, 2, 3, or 4 biotinylated MHC complexes 294. The composition according to item 26, wherein the bead is coated with polysaccharide, such as a polysaccharide comprising dextran moieties.

295. The composition according to item 290, wherein the natural interaction comprises the interaction of MHC complexes (comprising full-length polypeptide chains, including the transmembrane portion) with the cell membrane of for example dendritic cells 296. The composition according to item 286, wherein the non-covalent linkage comprises artificial interactions 297. The composition according to item 296, wherein the artificial interaction comprises His$_6$ tag interacting with Ni-NTA 298. The composition according to item 296, wherein the artificial interaction comprises PNA-PNA 299. The composition according to item 286, wherein the non-covalent linkage comprises non-specific adsorption 300. The composition according to item 299, wherein the non-specific adsorption comprises adsorption of proteins onto surfaces 301. The composition according to item 286, wherein the non-covalent linkage comprises the pentamer structure 302. The composition according to item 286, wherein the non-covalent linkage comprises interactions selected from the group streptavidin/biotin, avidin/biotin, antibody/antigen, DNA/DNA, DNA/PNA, DNA/RNA, PNA/PNA, LNA/DNA, leucine zipper e.g. Fos/Jun, IgG dimeric protein, IgM multivalent protein, acid/base coiled-coil helices, chelate/metal ion-bound chelate, streptavidin (SA) and avidin and derivatives thereof, biotin, immunoglobulins, antibodies (monoclonal, polyclonal, and recombinant), antibody fragments and derivatives thereof, leucine zipper domain of AP-1 (jun and fos), hexa-his (metal chelate moiety), hexa-hat GST (glutathione S-transferase) glutathione affinity, Calmodulin-binding peptide (CBP), Strep-tag, Cellulose Binding Domain, Maltose Binding Protein, S-Peptide Tag, Chitin Binding Tag, Immuno-reactive Epitopes, Epitope Tags, E2Tag, HA Epitope Tag, Myc Epitope, FLAG Epitope, AU1 and AU5 Epitopes, Glu-Glu Epitope, KT3 Epitope, IRS Epitope, Btag Epitope, Protein Kinase-C Epitope, VSV Epitope, lectins that mediate binding to a diversity of compounds, including carbohydrates, lipids and proteins, e.g. Con A (*Canavalia ensiformis*) or WGA (wheat germ agglutinin) and tetranectin or Protein A or G (antibody affinity).

303. The composition according to any of items 3 to 302, wherein the MHC multimer comprises stabilized empty MHC complexes and/or stabilized MHC-peptide complexes.

304. The composition according to item 303, wherein the MHC multimer comprises a soluble form of MHC I where the transmembrane and cytosolic domains of the membrane-anchored MHC complexes have been removed.

305. The composition according to item 303, wherein the MHC multimer comprises a soluble form of MHC II where the transmembrane and cytosolic domains of the membrane-anchored MHC complexes have been removed.

306. The composition according to item 303, wherein the stabilized empty MHC complexes and/or stabilized MHC-peptide complexes have been stabilized by generation of covalent protein-fusions.

307. The composition according to item 303, wherein the stabilized empty MHC complexes and/or stabilized MHC-peptide complexes have been stabilized by stabilization of the MHC I molecules by introduction of one or more linkers between the individual components of the MHC I complex such as generation of a complex consisting of a heavy chain fused with β2m through a linker and a soluble peptide, a heavy chain fused to β2m through a linker, a heavy chain/β2m dimer covalently linked to a peptide through a linker to either heavy chain or β2m, or where there can or can not be a linker between the heavy chain and β2m, a heavy chain fused to a peptide through a linker, or the α1 and α2 subunits of the heavy chain fused to a peptide through a linker.

308. The composition according to item 307, wherein each of the heavy chain, β2m and the peptide are truncated.

309. The composition according to item 307, wherein the linker is a flexible linker.

310. The composition according to item 307, wherein the linker is made of glycine and/or serine.

311. The composition according to item 307, wherein the linker is between 5-20 residues long, such as from 5-6 residues long, for example from 6-8 residues long, such as from 8-10 residues long, for example from 10-12 residues long, such as from 12-14 residues long, for example from 14-16 residues long, such as from 16-18 residues long and for example from 18-20 residues long.

312. The composition according to item 307, wherein the linker is longer than 20 residues long.

313. The composition according to item 307, wherein the linker is shorter than 5 residues long.

314. The composition according to item 307, wherein the linker is rigid with a defined structure.

315. The composition according to item 307, wherein the linker is made of amino acids like glutamate, alanine, lysine, and leucine creating e.g. a more rigid structure.

316. The composition according to item 303, wherein the stabilized empty MHC complexes and/or stabilized MHC-peptide complexes comprises heavy chain-β2m fusion proteins, wherein the COOH terminus of β2m can be covalently linked to the NH$_2$ terminus of the heavy chain, or the NH$_2$ terminus of β2m can be linked to the COOH terminus of the heavy chain.

317. The composition according to item 303, wherein the stabilized empty MHC complexes and/or stabilized MHC-peptide complexes comprises a fusion-protein comprising a β2m domain, or a truncated β2m domain, inserted into the heavy chain.

318. The composition according to item 303, wherein the stabilized empty MHC complexes and/or stabilized MHC-peptide complexes comprises a fusion-protein comprising a heavy chain domain, or a truncated heavy chain, inserted into the β2m chain, to form a fusion-protein of the form "β2m(first part)-heavy chain-β2m(last part)".

319. The composition according to item 303, wherein the stabilized empty MHC complexes and/or stabilized MHC-peptide complexes comprises peptide-β2m fusion proteins, wherein the COOH terminus of the peptide is linked to the NH$_2$ terminus of β2m or the peptide is linked to the COOH terminal of β2m via its NH$_2$ terminus.

320. The composition according to item 303, wherein the stabilized empty MHC complexes and/or stabilized MHC-peptide complexes comprises heavy chain-peptide fusion proteins, wherein the NH$_2$ terminus of the heavy chain is fused to the COOH terminus of the peptide, or the fusion is between the COOH terminus of the heavy chain and the NH$_2$ terminus of the peptide.

321. The composition according to item 303, wherein the stabilized empty MHC complexes and/or stabilized MHC-peptide complexes comprises heavy chain-β2m-peptide fusion proteins, wherein the NH$_2$ terminus of the heavy chain is fused to the COOH terminus of β2m and the NH$_2$ terminus of β2m can be fused to the COOH terminus of the peptide.

322. The composition according to item 303, wherein the stabilized empty MHC complexes and/or stabilized MHC-peptide complexes comprises non-covalent stabilization by binding to an unnatural component.

323. The composition according to item 322, wherein the unnatural component bind to both the heavy chain and the β2m.

324. The composition according to item 322, wherein the unnatural component bind to either β2m or heavy chain, and in this way stabilize the polypeptide in its correct conformation, and in this way increase the affinity of the heavy chain for β2m and/or peptide, or increase the affinity of β2m for peptide.

325. The composition according to item 322, wherein the unnatural component is one or more antibodies.

326. The MHC multimer according to claim 325, wherein the one or more antibodies can be selected from the group consisting of as truncated or full-length antibodies (of isotype IgG, IgM, IgA, IgE), Fab, scFv or bi-Fab fragments or diabodies.

327. The MHC multimer according to claim 325, wherein the one or more antibodies is one or more antibodies capable of binding the MHC I molecule by interaction with the heavy chain as well as β2m.

328. The MHC multimer according to claim 325, wherein the one or more antibodies is one or more bispecific antibodies that binds with one arm to the heavy chain and the other arm to the β2m of the MHC complex.

329. The MHC multimer according to claim 325, wherein the one or more antibodies is monospecific, and bind at the interface between heavy chain and β2m.

330. The MHC multimer according to claim 325, wherein the one or more antibodies is one or more antibodies capable of binding the heavy chain but only when the heavy chain is correct folded.

331. The MHC multimer according to claim 325, wherein the one or more antibodies is the antibody produced by the clone W6/32 such as M0736 or the like that recognizes a conformational epitope on intact human and some monkey MHC complexes comprising β2m, heavy chain and peptide.

332. The composition according to item 322, wherein the unnatural component is one or more peptides.

333. The composition according to item 322, wherein the unnatural component is one or more aptamers.

334. The composition according to item 322, wherein the unnatural component is one or more molecules with the ability to bind peptides stretches of the MHC complex.

335. The composition according to item 303, wherein the stabilized empty MHC complexes and/or stabilized MHC-peptide complexes comprises generation of modified proteins or protein components.

336. The composition according to item 303, wherein the stabilized empty MHC complexes and/or stabilized MHC-peptide complexes comprises improved stability of a MHC I complex by increasing the affinity of the binding peptide for the MHC complex.

337. The composition according to item 335, wherein the generation of modified proteins or protein components comprises mutagenesis of one or more amino acids at relevant positions in the peptide.

338. The composition according to item 335, wherein the generation of modified proteins or protein components comprises substitution of one or more amino acids at relevant positions in the peptide.

339. The composition according to item 335, wherein the generation of modified proteins or protein components comprises chemical modifications of amino acids at relevant positions in the peptide.

340. The composition according to item 335, wherein the generation of modified proteins or protein components comprises introduction by synthesis of non-natural amino acids at relevant positions in the peptide.

341. The composition according to item 335, wherein the generation of modified proteins or protein components comprises mutations, chemical modifications, insertion of natural or non-natural amino acids or deletions in the peptide binding cleft, i.e. in the binding pockets that accommodate peptide side chains responsible for anchoring the peptide to the peptide binding cleft.

342. The composition according to item 335, wherein the generation of modified proteins or protein components comprises introduction of one or more reactive groups into the antigenic peptide;

343. The composition according to item 335, wherein the generation of modified proteins or protein components comprises mutations, chemical modifications, insertion of natural or non-natural amino acids or deletions in the heavy chain and/or β2m at positions outside the peptide-binding cleft.

344. The composition according to item 335, wherein the generation of modified proteins or protein components comprises removal of "unwanted cysteine residues" in the heavy chain by mutation, chemical modification, amino acid exchange or deletion.

345. The composition according to item 303, wherein the stabilized empty MHC complexes and/or stabilized MHC-peptide complexes comprises covalent stabilization of MHC I complex, wherein a linker is covalently attached between two of the subunits of the MHC complex such as a linker between peptide and heavy chain or between heavy chain and beta2microglobulin.

346. The composition according to item 303, wherein the stabilized empty MHC complexes and/or stabilized MHC-peptide complexes comprises eukaryotic expression systems for production of MHC II molecules such as stable Drosophila cell transfectants, baculovirus infected insect cells, CHO cells or other mammalian cell lines suitable for expression of proteins.

347. The composition according to item 303, wherein the stabilized empty MHC complexes and/or stabilized MHC-peptide complexes comprises generation of covalent protein-fusions.

348. The composition according to item 303, wherein the stabilized empty MHC complexes and/or stabilized MHC-peptide complexes comprises stabilization of MHC II complexes by introduction of one or more linkers e.g. between the individual components of the MHC II complex such as a α/β dimer with a linker between α-chain and β-chain; a α/β dimer covalently or non-covalently linked to the peptide via a linker to either the α-chain or β-chain; a α/β dimer, covalently or non-covalently linked by a linker between the α-chain and β-chain, and where the dimer is covalently or non-covalently linked to the peptide or a α/β dimer with a linker between α-chain and 3-chain, where the dimer is combined with a peptide covalently or non-covalently linked to either α-chain or β-chain.

349. The composition according to item 348, wherein the linker is a flexible linker.

350. The composition according to item 348, wherein the linker is made of glycine and/or serine.

351. The composition according to item 348, wherein the linker is between 5-20 residues long, such as from 5-6 residues long, for example from 6-8 residues long, such as from 8-10 residues long, for example from 10-12 residues long, such as from 12-14 residues long, for example from 14-16 residues long, such as from 16-18 residues long and for example from 18-20 residues long.

352. The composition according to item 348, wherein the linker is longer than 20 residues long.

353. The composition according to item 348, wherein the linker is shorter than 5 residues long.

354. The composition according to item 348, wherein the linker is rigid with a more defined structure, e.g. made of amino acids like glutamate, alanine, lysine, and leucine.

355. The composition according to item 303, wherein the stabilized empty MHC complexes and/or stabilized MHC-peptide complexes comprises peptides linked to the $NH_2$- or COOH-terminus of either α-chain or β-chain.

356. The composition according to item 303, wherein the stabilized empty MHC complexes and/or stabilized MHC-peptide complexes comprises peptides linked to the $NH_2$-terminus of the β-chain via their COOH-terminus, since the linker required is shorter than if the peptide is linked to the COOH-terminus of the β-chain.

357. The composition according to item 303, wherein the stabilized empty MHC complexes and/or stabilized MHC-peptide complexes comprises linkage of α-chain to β-chain via the COOH-terminus of the β-chain to the $NH_2$-terminus of the α-chain or from the COOH-terminus of the α-chain to the $NH_2$-terminus of the β-chain.

358. The composition according to item 303, wherein the stabilized empty MHC complexes and/or stabilized MHC-peptide complexes comprises a three-molecule fusion protein consisting of α-chain, β-chain and peptide e.g. where one linker connect the COOH-terminus of the β-chain with the $NH_2$-terminus of the α-chain and another linker connects the COOH-terminal of the peptide with the $NH_2$-terminal of the β-chain or one linker joins the COOH-terminus of the α-chain with the $NH_2$-terminus of the β-chain and the second linker joins the $NH_2$-terminus of the peptide with the COOH-terminus of the β-chain.

359. The composition according to item 303, wherein the stabilized empty MHC complexes and/or stabilized MHC-peptide complexes comprises non-covalent stabilization by binding ligand.

360. The composition according to item 303, wherein the stabilized empty MHC complexes and/or stabilized MHC-peptide complexes comprises non-covalent binding of ligands to the MHC II complex to promote assembly of α- and β-chain by bridging the two chains, or by binding to either of the α- or β-chains, and in this way stabilize the conformation of α or β, that binds β or α, respectively, and/or that binds the peptide.

361. The composition according to item 360, wherein the ligands are one or more antibodies.

362. The composition according to item 361, wherein the one or more antibodies are one or more antibodies binding the MHC complex distal to the interaction site with TCR, i.e. distal to the peptide-binding cleft.
363. The composition according to item 361, wherein the one or more antibodies are any truncated or full length antibody of any isotype (e.g. IgG, IgM, IgA or IgE), a bi-Fab fragment or a diabody.
364. The composition according to item 361, wherein the one or more antibodies are bispecific with one arm binding to the α-chain and the other arm binding to the β-chain.
365. The composition according to item 361, wherein the one or more antibodies are monospecific and directed to a sequence fused to the α-chain as well as to the β-chain.
366. The composition according to item 361, wherein the one or more antibodies are monospecific and binds to a surface of the complex that involves both the α- and β-chain, e.g. both the α2- and β2-domain or both the α1- and α1-domain.
367. The composition according to item 360, wherein the ligands are one or more peptides.
368. The composition according to item 360, wherein the ligands are one or more aptamers.
369. The composition according to item 360, wherein the ligands are one or more molecules with the ability to bind proteins.
370. The composition according to item 360, wherein the ligands are one or more ligand that binds at the α-/β-chain interface, e.g. peptides and aptamers.
371. The composition according to item 360, wherein the ligands are one or more ligands that bind the peptide, although, in this case it is important that the ligand does not interfere with the interaction of the peptide or binding cleft with the TCR.
372. The composition according to item 303, wherein the stabilized empty MHC complexes and/or stabilized MHC-peptide complexes comprises non-covalent stabilization by induced multimerization.
373. The composition according to item 372, wherein the multimerization comprises anchoring of the α- and β-chains in the cell membrane leading to stabilization of the MHC II complexes.
374. The composition according to item 372, wherein the multimerization comprises stabilization of the α/β-dimer by attachment of the MHC II chains to the Fc regions of an antibody, leading to a stable α/β-dimer, where α and β are held together by the tight interactions between two Fc domains of an antibody.
375. The composition according to item 372, wherein the multimerization comprises one or more dimerization domains.
376. The composition according to item 372, wherein the multimerization comprises MHC II molecules incorporated into artificial membrane spheres like liposomes or lipospheres.
377. The composition according to item 372, wherein the multimerization comprises MHC II molecules incorporated as monomers or as dimers in a membrane.
378. The composition according to item 372, wherein the multimerization comprises biotinylation of α- as well as β-chain and the two chains brought together by binding to streptavidin.
379. The composition according to item 372, wherein the multimerization comprises long flexible linkers such as extended glycine-serine tracts used to extend both chains, whereafter the chains are biotinylated at the end of such extended linkers and streptavidin is used as a scaffold to bring the chains together in the presence of the peptide, while the flexible linkers still allow the chains to orientate properly.
380. The composition according to item 303, wherein the stabilized empty MHC complexes and/or stabilized MHC-peptide complexes comprises generation of modified proteins or protein components.
381. The composition according to item 303, wherein the stabilized empty MHC complexes and/or stabilized MHC-peptide complexes comprises stabilization of MHC II complexes by covalent modifications of the protein.
382. The composition according to item 303, wherein the stabilized empty MHC complexes and/or stabilized MHC-peptide complexes comprises increase of the affinity of the peptide for the MHC complex e.g. by exchange of the natural amino acids with other natural or non-natural amino acids at relevant positions in the peptide or by chemical modifications of amino acids at relevant positions in the peptide or mutations, chemical modifications, insertion of natural or non-natural amino acids or deletions can be introduced in the peptide-binding cleft or mutations, chemical modifications, insertion of natural or non-natural amino acids or deletions is introduced in α- and/or β-chain at positions outside the peptide-binding cleft.
383. The composition according to item 303, wherein the stabilized empty MHC complexes and/or stabilized MHC-peptide complexes comprises replacement of the hydrophobic transmembrane regions of α-chain and β-chain by leucine zipper dimerisation domains (e.g. Fos-Jun leucine zipper; acid-base coiled-coil structure) to promote assembly of α-chain and β-chain.
384. The composition according to item 303, wherein the stabilized empty MHC complexes and/or stabilized MHC-peptide complexes comprises introduction of one or more cysteine residues by amino acid exchange at the COOH-terminal of both α-chain and β-chain, to create disulfide bridges between the two chains upon assembly of the MHC complex.
385. The composition according to item 303, wherein the stabilized empty MHC complexes and/or stabilized MHC-peptide complexes comprises removal of "unwanted cysteine residues" in either of the chains by mutation, chemical modification, amino acid exchange or deletion.
386. The composition according to item 303, wherein the stabilized empty MHC complexes and/or stabilized MHC-peptide complexes comprises stabilization of MHC II complexes by chemically linking together the subunits and the peptide e.g. by a linker between peptide and α-chain, between peptide and β-chain, between α-chain and β-chain, or combination thereof.
387. The composition according to item 303, wherein the stabilized empty MHC complexes and/or stabilized MHC-peptide complexes comprises chemically modified MHC complexes.
388. The composition according to item 387, wherein the chemically modified MHC complexes comprises one or more amino acids reacted with one or more chemical cross linkers.
389. The composition according to item 387, wherein the chemically modified MHC complexes comprises that the amino group at the N-terminal of both chains and of the peptide, as well as amino groups of lysine side chains, are nucleophilic and can be used in a chemical reaction.
390. The composition according to item 389, wherein the chemical reaction is nucleophilic substitution by activation of electrophiles (e.g. acylation such as amide formation, pyrazolone formation, isoxazolone formation; alkylation; vinylation; disulfide formation), 391. The composition according to item 389, wherein the chemical reaction is addition to carbon-hetero multiple bonds (e.g. alkene formation by reaction of phosphonates with aldehydes or ketones; arylation; alkylation of arenes/hetarenes by reaction with alkyl boronates or enolethers).

392. The composition according to item 389, wherein the chemical reaction is nucleophilic substitution using activation of nucleophiles (e.g. condensations; alkylation of aliphatic halides or tosylates with enolethers or enamines).

393. The composition according to item 389, wherein the chemical reaction is one or more cycloadditions.

394. The composition according to item 389, wherein the chemical reaction comprises use of activated carboxylic acids such as NHS-ester, tetra and pentafluoro phenolic esters, anhydrides, acid chlorides and fluorides.

395. The composition according to item 389, wherein the chemical reaction comprises use of sulphonyl chlorides.

396. The composition according to item 389, wherein the chemical reaction comprises use of iso-Cyanates and/or isothiocyanates.

397. The composition according to item 389, wherein the chemical reaction comprises use of Aldehydes, such as formaldehyde and glutardialdehyde.

398. The composition according to item 389, wherein the chemical reaction comprises alkylation by maleimides, vinyl sulphones and halides.

399. The composition according to item 389, wherein the chemical reaction comprises use of carboxylic acids at the C-terminal of both chains and peptide, as well as on the side chains of glutamic and aspartic acid, to introduce cross-links.

400. The composition according to item 389, wherein the chemical reaction use of carbodiimides.

401. The composition according to item 389, wherein the chemical reaction any chemistries that can be employed to form covalent cross-links.

402. The composition according to item 389, wherein the chemical reaction comprises one or more chemical reagents that are bi-functional.

403. The composition according to item 389, wherein the chemical reaction comprises one or more chemical reagents that are homo bi-functional such as glutardialdehyde.

404. The composition according to item 389, wherein the chemical reaction comprises one or more chemical reagents that are hetero bi-functional such as GMBS (MaleimidoButyryloxy-Succinimide ester).

405. The composition according to item 389, wherein the chemical reaction comprises use of two or more reagents.

406. The composition according to item 389, wherein the chemical reaction comprises that GMBS is used to introduce maleimides on the α-chain, and iminothiolane is used to introduce thiols on the β-chain, whereafter the malemide and thiol can then form a thioether link between the two chains.

407. The composition according to item 389, wherein the chemical reaction comprises one or more types of cross-links.

408. The composition according to item 389, wherein the chemical reaction comprises that the folded MHC-complex can be reacted with dextrans possessing a large number (up to many hundreds) of vinyl sulphones, which can react with lysine residues on both the α and β chains as well as with lysine residues on the peptide protruding from the binding site, effectively cross linking the entire MHC-complex.

409. The composition according to item 389, wherein the chemical reaction comprises activation of dextran e.g. with vinyl sulphones.

410. The composition according to item 389, wherein the chemical reaction comprises that a dextran is reacted both with one or several MHC-complexes and one or more fluorescent protein such as APC.

411. The composition according to item 389, wherein the chemical reaction comprises one or more chemical cross linkers.

412. The composition according to item 389, wherein the chemical reaction comprises that one or more lysine residues are inserted into the α-chain, juxtaposed with glutamic acids in the β-chain, where after the introduced amino groups and carboxylic acids are reacted by addition of carbodiimide.

413. The composition according to item 389, wherein the chemical reaction comprises that one or more dextran multimerization domain(s) are cross-linked with appropriately modified MHC-complexes; i.e. one or both chains of the MHC complex can be enriched with lysine residues, increasing reactivity towards the vinylsulphone dextran.

414. The composition according to item 413, wherein the lysine residues are inserted at positions opposite the peptide binding cleft, orienting the MHC-complexes favourably for T-cell recognition.

415. The composition according to item 389, wherein the chemical reaction comprises use of one or more extended and flexible cross-linkers.

416. The composition according to item 303, wherein the stabilized empty MHC complexes and/or stabilized MHC-peptide complexes comprises stabilization with one or more soluble additives.

417. The composition according to item 416, wherein the one or more soluble additives comprises one or more salts.

418. The composition according to item 416, wherein the one or more soluble additives comprises one or more detergents.

419. The composition according to item 416, wherein the one or more soluble additives comprises one or more organic solvents.

420. The composition according to item 416, wherein the one or more soluble additives comprises one or more polymers.

421. The composition according to item 416, wherein the one or more soluble additives comprises one or more soluble additives that increase the stability of MHC complexes.

422. The composition according to item 416, wherein the one or more soluble additives comprises one or more soluble additives that increase the surface tension of the MHC complex.

423. The composition according to item 416, wherein the one or more soluble additives comprises one or more of the soluble additives selected from the group consisting of sucrose, mannose, glycine, betaine, alanine, glutamine, glutamic acid, ammonium sulphate, glycerol, mannitol and sorbitol.

424. The composition according to item 416, wherein the one or more soluble additives comprises one or more soluble additives that increase the surface tension of the MHC complex and simultaneously can interact with charged groups in the protein.

425. The composition according to item 416, wherein the one or more soluble additives comprises one or more of the soluble additives selected from the group consisting of $MgSO_4$, NaCl, polyethylenglycol, 2-methyl-2,4-pentanediol and guanidiniumsulphate.

426. The composition according to item 416, wherein the one or more soluble additives comprises molar excess of peptide.

427. The composition according to item 416, wherein the one or more soluble additives comprises molar excess β2m.

428. The composition according to item 416, wherein the one or more soluble additives comprises molar excess β2m and molar excess of peptide identical to the peptide bound in the peptide-binding cleft.

429. The composition according to item 416, wherein the one or more soluble additives comprises one or more of the soluble additives selected from the group consisting of BSA, fetal and bovine calf serum, and other protein components in serum with a protein stabilizing effect.

430. The composition according to item 416, wherein the one or more soluble additives are added to any solution comprising MHC complexes in order to increase the stability of the molecule.

431. The composition according to item 416, wherein the one or more soluble additives are added during the refolding process.

432. The composition according to item 416, wherein the one or more soluble additives are added to the formed MHC complex.

433. The composition according to item 416, wherein the one or more soluble additives are added to a solution of MHC multimers comprising several MHC complexes.

434. The composition according to any of items 3 to 303 further comprising one or more molecules with adjuvant effect.

435. The composition according to any of items 3 to 303 further comprising one or more immune targets.

436. The MHC multimer according to any of item 435, wherein the one or more immune targets is an antigen.

437. The composition according to any of items 3 to 303 further comprising one or more molecules with biological activity.

438. The composition according to any of items 3 to 303 further comprising one or more molecules with a cytotoxic effect.

439. The composition according to any of items 3 to 303 further comprising one or more molecules selected from the group consisting of enzymes, regulators of receptor activity, receptor ligands, immune potentiators, drugs, toxins, co-receptors, proteins, peptides, sugar moieties, lipid groups, nucleic acids including siRNA, nano particles, and small molecules.

440. The composition according to any of items 3 to 303 further comprising one or more molecules selected from the group consisting of HIV gp120, HIV-GAG gp 27, HSP70, and MHC class II proteins or peptides or combinations thereof.

441. The composition according to any of items 3 to 303 further comprising one or more immuno active molecules.

442. The composition according to item 441, wherein the one or more immuno active molecules are identical.

443. The composition according to item 441, wherein the one or more immuno active molecules are different.

444. The composition according to item 441, wherein the one or more immuno active molecules are selected from the group consisting of biological active molecules including proteins, co-stimulatory molecules, cell modulating molecules, receptors, accessory molecules, adhesion molecules, natural ligands, and toxic molecules, as well as antibodies and recombinant binding molecules to any of the foregoing, and combinations thereof.

445. The composition according to item 441, wherein the one or more immuno active molecules comprises one or more molecules selected from the group consisting of MHC Class I-like proteins like MIC A, MIC B, CDId, HLA E, HLA F, HLA G, HLA H, ULBP-1, ULBP-2, and ULBP-3, co-stimulatory molecules such as CD2, CD3, CD4, CD5, CD8, CD9, CD27, CD28, CD30, CD69, CD134 (OX40), CD137 (4-1BB), CD147, CDw150 (SLAM), CD152 (CTLA-4), CD153 (CD30L), CD40L (CD154), NKG2D, ICOS, HVEM, HLA Class II, PD-1, Fas (CD95), FasL expressed on T and/or NK cells, CD40, CD48, CD58, CD70, CD72, B7.1 (CD80), B7.2 (CD86), B7RP-1, B7-H3, PD-L1, PD-L2, CD134L, CD137L, ICOSL, LIGHT expressed on APC and/or tumour cells, cell modulating molecules such as CD16, NKp30, NKp44, NKp46, NKp80, 2B4, KIR, LIR, CD94/NKG2A, CD94/NKG2C expressed on NK cells, IFN-alpha, IFN-beta, IFN-gamma, IL-1, IL-2, IL-3, IL-4, IL-6, IL-7, IL-8, IL-10, IL-11, IL-12, IL-15, CSFs (colony-stimulating factors), vitamin D3, IL-2 toxins, cyclosporin, FK-506, rapamycin, TGF-beta, clotrimazole, nitrendipine, and charybdotoxin, accessory molecules such as LFA-1, CDIIa/18, CD54 (ICAM-1), CD106 (VCAM), and CD49a, b, c, d, e, f/CD29 (VLA-4), adhesion molecules such as ICAM-1, ICAM-2, GlyCAM-1, CD34, anti-LFA-1, anti-CD44, anti-beta7, chemokines, CXCR4, CCR5, anti-selectin L, anti-selectin E, and anti-selectin P, toxic molecules selected from toxins, enzymes, antibodies, radioisotopes, chemiluminescent substances, bioluminescent substances, polymers, metal particles, and haptens, such as cyclophosphamide, methrotrexate, Azathioprine, mizoribine, 15-deoxuspergualin, neomycin, staurosporine, genestein, herbimycin A, *Pseudomonas* exotoxin A, saporin, Rituxan, Ricin, gemtuzumab ozogamicin, Shiga toxin, heavy' metals like inorganic and organic mercurials, and FN18-CRM9, radio-isotopes such as incorporated isotopes of iodide, cobalt, selenium, tritium, and phosphor, and haptens such as DNP, and digoxiginin, and combinations of any of the foregoing, as well as antibodies (monoclonal, polyclonal, and recombinant) to the foregoing, where relevant and antibody derivatives or fragments thereof.

446. The composition according to item 441, wherein the one or more immuno active molecules are derived from viral or bacterial proteins or fragments thereof.

447. The composition according to item 441, wherein the one or more immuno active molecules are attached to the multimerization domain(s) either directly, through one or more linkers or via one or more of the binding entities or one or more multimerization domains.

448. The composition according to item 441, wherein the one or more immuno active molecules are linked to another immunoactive molecules and then attached to one or more multimerization domains.

449. The composition according to any of items 3 to 303, wherein the MHC multimer is covalently or non-covalently associated with various molecules such as molecules with adjuvant effects, immune targets such as antigens, molecules with biological activity such as enzymes, regulators of receptor activity, receptor ligands, immune potentiators, drugs, toxins, co-receptors, proteins and peptides in general; sugar moieties; lipid groups; nucleic acids including siRNA; nano particles; small molecules.

450. The composition according to any of items 3 to 303, wherein the MHC multimer is covalently or non-covalently associated with one or more biologically active molecules and/or one or more immuno active molecules.

451. The composition according to item 450, wherein the one or more biologically active molecules and/or one or more immuno active molecules are attachment by chemical reactions between reactive groups on the biologically active molecule or immuno active molecule and reactive groups of the multimerisation domain and/or between reactive groups on the biologically active molecule or immuno active molecule and reactive groups of the MHC-peptide complex.

452. The composition according to item 450, wherein the one or more biologically active molecules and/or one or more immuno active molecules are attachment by non-covalent interaction between part of the multimerisation domain and part of the biological active molecule or immuno active molecule; or between part of the MHC-peptide complex and part of the biological active molecule or immuno active molecule.

453. The composition according to item 450, wherein the one or more biologically active molecules and/or one or more immuno active molecules are attachment by covalent and non-covalent attachment of the biologically molecule or immuno active molecule to the multimerisation domain by a linker molecule.

454. The composition according to item 450, wherein the one or more biologically active molecules and/or one or more immuno active molecules are attachment by repetitively attachment aiding to recognition by and stimulation of the innate immune system via Toll or other receptors.

455. The composition according to any of items 3 to 454 comprising a plurality of identical or different multimerization domains linked by a multimerization domain linking moiety,
wherein at least one of said multimerization domains is associated with $(a-b-P)_n$, wherein $n>1$,
wherein a and b together form a functional MHC protein capable of binding the peptide P, when P is present
wherein (a-b-P) is the MHC-peptide complex formed when the peptide P binds to the functional MHC protein.

456. The composition according to item 455, wherein the plurality of identical or different multimerization domains is in the range of from 2 to 100, such as 2 to 5, 5 to 10, 10 to 20, 20 to 30, 30 to 40, 40 to 50, 50 to 60, 60 to 70, 70 to 80, 80 to 90, 90 to 100.

457. The composition according to item 455, wherein the MHC multimer comprises a first multimerization domain linked to a second multimerization domain.

458. The composition according to item 457, wherein the first multimerization domain and the second multimerization domain is independently selected from the group consisting of multimerization domains cited in any of items 4 to 37.

459. The composition according to item 457, wherein the association is a covalent linkage so that one or more of the n MHC-peptide complexes is covalently linked to the first multimerization domains.

460. The composition according to item 457, wherein the association is a non-covalent association so that one or more of the n MHC-peptide complexes is non-covalently associated with the first multimerization domain.

461. The composition according to item 457, wherein the first multimerization domain comprises one or more scaffolds.

462. The composition according to item 457, wherein the first multimerization domain comprises one or more carriers.

463. The composition according to item 457, wherein the first multimerization domain comprises at least one scaffold and at least one carrier.

464. The composition according to item 457, wherein the first multimerization domain comprises one or more optionally substituted organic molecules.

465. The composition according to item 464, wherein the optionally substituted organic molecule comprises one or more functionalized cyclic structures.

466. The composition according to item 465, wherein the one or more functionalized cyclic structures comprises one or more benzene rings.

467. The composition according to item 464, wherein the optionally substituted organic molecule comprises a scaffold molecule comprising at least three reactive groups, or at least three sites suitable for non-covalent attachment.

468. The composition according to item 457, wherein the first multimerization domain comprises one or more biological cells, such as antigen presenting cells or dendritic cells.

469. The composition according to item 457, wherein the first multimerization domain comprises one or more membranes.

470. The composition according to item 469, wherein the one or more membranes comprises liposomes or micelles.

471. The composition according to item 457, wherein the first multimerization domain comprises one or more polymers.

472. The composition according to item 471, wherein the one or more polymers are selected from the group consisting of the group consisting of polysaccharides.

473. The composition according to item 472, wherein the polysaccharide comprises one or more dextran moieties.

474. The composition according to item 457, wherein the first multimerization domain comprises one or more entities selected from the group consisting of an IgG domain, a coiled-coil polypeptide structure, a DNA duplex, a nucleic acid duplex, PNA-PNA, PNA-DNA, DNA-RNA.

475. The composition according to item 457, wherein the first multimerization domain comprises an avidin, such as streptavidin.

476. The composition according to item 457, wherein the first multimerization domain comprises an antibody.

477. The composition according to item 476, wherein the antibody is selected from the group consisting of polyclonal antibody, monoclonal antibody, IgA, IgG, IgM, IgD, IgE, IgG1, IgG2, IgG3, IgG4, IgA1, IgA2, IgM1, IgM2, humanized antibody, humanized monoclonal antibody, chimeric antibody, mouse antibody, rat antibody, rabbit antibody, human antibody, camel antibody, sheep antibody, engineered human antibody, epitope-focused antibody, agonist antibody, antagonist antibody, neutralizing antibody, naturally-occurring antibody, isolated antibody, monovalent antibody, bispecific antibody, trispecific antibody, multispecific antibody, heteroconjugate antibody, immunoconjugates, immunoliposomes, labeled antibody, antibody fragment, domain antibody, nanobody, minibody, maxibody, diabody, fusion antibody.

478. The composition according to item 457, wherein the first multimerization domain comprises one or more small organic scaffold molecules.

479. The composition according to item 457, wherein the first multimerization comprises one or more further polypeptides in addition to a and b.

480. The composition according to item 457, wherein the first multimerization comprises one or more protein complexes.

481. The composition according to item 457, wherein the first multimerization comprises one or more beads 482. The composition according to item 457, wherein the first multimerization domain comprises one or more compounds selected from the group consisting of agarose, sepharose, resin beads, glass beads, pore-glass beads, glass particles coated with a hydrophobic polymer, chitosan-coated beads, SH beads, latex beads, spherical latex beads, allele-type beads, SPA bead, PEG-based resins, PEG-coated bead, PEG-encapsulated bead, polystyrene beads, magnetic polystyrene beads, glutathione agarose beads, magnetic bead, paramagnetic beads, protein A and/or protein G sepharose beads, activated carboxylic acid bead, macroscopic beads, microscopic beads, insoluble resin beads, silica-based resins, cellulosic resins, cross-linked agarose beads, polystyrene beads, cross-linked polyacrylamide resins, beads with iron cores, metal beads, dynabeads, Polymethylmethacrylate beads activated with NHS, streptavidin-agarose beads, polypropylene, polyethylene, dextran, nylon, amylases, natural and modified celluloses, nitrocellulose, polyacrylamides, gabbros, magnetite, polymers, oligomers, non-repeating moieties, polyethylene glycol (PEG), monomethoxy-PEG, mono-($C_1$-$C_{10}$)alkoxy-PEG, aryloxy-PEG, poly-(N-vinyl pyrrolidone)PEG, tresyl monomethoxy PEG, PEG propionaldehyde, bis-succinimidyl carbonate PEG, polystyrene bead crosslinked with divinylbenzene, propylene glycol homopolymers, a polypropylene oxide/ethylene oxide co-polymer, polyoxyethylated polyols (e.g., glycerol), polyvinyl alcohol, dextran, aminodextran, carbohydrate-based polymers, cross-linked dextran beads, polysaccharide beads, polycarbamate beads, divinyl sulfone activated polysaccharide, polystyrene beads that have been functionalized with tosyl-activated esters, magnetic polystyrene beads functionalized with tosyl-activated esters, streptavidin beads, streptaivdin-monomer coated beads, streptaivdin-tetramer coated beads, Streptavidin Coated Compel Magnetic beads, avidin coated beads, dextramer coated beads, divinyl sulfone-activated dextran, Carboxylate-modified bead, amine-modified beads, antibody coated beads, cellulose beads, grafted co-poly beads, poly-acrylamide beads, dimethylacrylamide beads optionally cross-linked with N—N'-bis-acryloylethylenediamine, hollow fiber membranes, fluorescent beads, collagen-agarose beads, gelatin beads, collagen-gelatin beads, collagen-fibronectin-gelatin beads, collagen beads, chitosan beads, collagen-chitosan beads, protein-based beads, hydrogel beads, hemicellulose, alkyl cellulose, hydroxyalkyl cellulose, carboxymethylcellulose, sulfoethylcellulose, starch, xylan, amylopectine, chondroitin, hyarulonate, heparin, guar, xanthan, mannan, galactomannan, chitin and chitosan.

483. The composition according to item 457, wherein the first multimerization domain comprises a dimerization domain.

484. The composition according to item 457, wherein the first multimerization domain comprises a trimerization domain.

485. The composition according to item 457, wherein the first multimerization domain comprises a tetramerization domain.

486. The composition according to item 457, wherein the first multimerization domain comprises a pentamerization domain.

487. The composition according to item 486, wherein the pentamerization domain comprises a coiled-coil polypeptide structure.

488. The composition according to item 457, wherein the first multimerization domain comprises a hexamerization domain.

489. The composition according to item 488, wherein the hexamerization domain comprises three IgG domains.

490. The composition according to item 457, wherein the first multimerization domain comprises a polymer structure to which is attached one or more scaffolds.

491. The composition according to item 490, wherein the polymer structure comprises a polysaccharide.

492. The composition according to item 491, wherein the polysaccharide comprises one or more dextran moieties.

493. The composition according to item 457, wherein the first multimerization domain comprises a polyamide and/or a polyethylene glycol and/or a polysaccharide and/or a sepharose.

494. The composition according to item 457, wherein the first multimerization domain comprises a carboxy methyl dextran and/or a dextran polyaldehyde and/or a carboxymethyl dextran lactone and/or or a cyclodextrin.

495. The composition according to item 457, wherein one or more labels is covalently attached to the first multimerization domain.

496. The composition according to item 457, wherein one or more labels is non-covalently attached to the first multimerization domain.

497. The composition according to item 496, wherein the one or more labels is non-covalently attached to an antibody in the first mutimerization domain.

498. The MHC multimer according item 495, wherein the one or more labels is covalently attached to an antibody in the first mutimerization domain.

499. The MHC multimer according to item 496, wherein the one or more labels is non-covalently attached to an aptamer in the first mutimerization domain.

500. The MHC multimer according to item 495, wherein the one or more labels is covalently attached to an aptamer in the first mutimerization domain.

501. The MHC multimer according to item 496, wherein the one or more labels is non-covalently attached to a molecule in the first mutimerization domain.

502. The MHC multimer according to item 495, wherein the one or more labels is covalently attached to a molecule in the first mutimerization domain.

503. The MHC multimer according to item 496, wherein the one or more labels is non-covalently attached to a protein in the first mutimerization domain.

504. The MHC multimer according to item 495, wherein the one or more labels is covalently attached to a protein in the first mutimerization domain.

505. The MHC multimer according to item 496, wherein the one or more labels is non-covalently attached to a sugar residue in the first mutimerization domain.

506. The MHC multimer according to item 495, wherein the one or more labels is covalently attached to a sugar residue in the first mutimerization domain.

507. The MHC multimer according to item 496, wherein the one or more labels is non-covalently attached to a DNA in the first mutimerization domain.

508. The MHC multimer according to item 495, wherein the one or more labels is covalently attached to a DNA in the first mutimerization domain.

509. The MHC multimer according to any of the items 495 to 508, wherein the attachment is directly between reactive groups in the labelling molecule and reactive groups in the marker molecule.

510. The MHC multimer according to any of the items 495 to 508, wherein the attachment is through a linker connecting labelling molecule and marker.

511. The MHC multimer according to any of the items 495 to 510, wherein one label is used.

512. The MHC multimer according to any of the items 495 to 510, wherein more than one label is used.

513. The composition according to item 512, wherein the more than one label are all identical.

514. The composition according to item 512, wherein at least two labels are different.
515. The composition according to any of items 495 to 514, wherein the one or more labels is a fluorophore.
516. The composition according to item 515, wherein the one or more fluorophore label are selected from the group consisting of selected from the group fluorescein isothiocyanate, rhodamine, phycoerythrin, phycocyanin, allophycocyanin, o-phthaldehyde and fluorescamine.
517. The composition according to item 515, wherein the one or more fluorophore label are selected from the group consisting of 2-(4'-maleimidylanilino)naphthalene-6-sulfonic acid, sodium salt
518. The composition according to item 515, wherein the one or more fluorophore label are selected from the group consisting of 5-((((2-iodoacetyl)amino)ethyl)amino) naphthalene-1-sulfonic acid
519. The composition according to item 515, wherein the one or more fluorophore label are selected from the group consisting of Pyrene-1-butanoic acid
520. The composition according to item 515, wherein the one or more fluorophore label are selected from the group consisting of AlexaFluor 350 (7-amino-6-sulfonic acid-4-methyl coumarin-3-acetic acid
521. The composition according to item 515, wherein the one or more fluorophore label are selected from the group consisting of AMCA (7-amino-4-methyl coumarin-3-acetic acid
522. The composition according to item 515, wherein the one or more fluorophore label are selected from the group consisting of 7-hydroxy-4-methyl coumarin-3-acetic acid
523. The composition according to item 515, wherein the one or more fluorophore label are selected from the group consisting of Marina Blue (6,8-difluoro-7-hydroxy-4-methyl coumarin-3-acetic acid
524. The composition according to item 515, wherein the one or more fluorophore label are selected from the group consisting of 7-dimethylamino-coumarin-4-acetic acid
525. The composition according to item 515, wherein the one or more fluorophore label are selected from the group consisting of Fluorescamin-N-butyl amine adduct
526. The composition according to item 515, wherein the one or more fluorophore label are selected from the group consisting of 7-hydroxy-coumarine-3-carboxylic acid
527. The composition according to item 515, wherein the one or more fluorophore label are selected from the group consisting of CascadeBlue (pyrene-trisulphonic acid acetyl azide
528. The composition according to item 515, wherein the one or more fluorophore label are selected from the group consisting of Cascade Yellow
529. The composition according to item 515, wherein the one or more fluorophore label are selected from the group consisting of Pacific Blue (6,8 difluoro-7-hydroxy coumarin-3-carboxylic acid
530. The composition according to item 515, wherein the one or more fluorophore label are selected from the group consisting of 7-diethylamino-coumarin-3-carboxylic acid
531. The composition according to item 515, wherein the one or more fluorophore label are selected from the group consisting of N-(((4-azidobenzoyl)amino)ethyl)-4-amino-3,6-disulfo-1,8-naphthalimide, dipotassium salt
532. The composition according to item 515, wherein the one or more fluorophore label are selected from the group consisting of Alexa Fluor 430
533. The composition according to item 515, wherein the one or more fluorophore label are selected from the group consisting of 3-perylenedodecanoic acid
534. The composition according to item 515, wherein the one or more fluorophore label are selected from the group consisting of 8-hydroxypyrene-1,3,6-trisulfonic acid, trisodium salt
535. The composition according to item 515, wherein the one or more fluorophore label are selected from the group consisting of 12-(N-(7-nitrobenz-2-oxa-1,3-diazol-4-yl) amino)dodecanoic acid
536. The composition according to item 515, wherein the one or more fluorophore label are selected from the group consisting of N,N'-dimethyl-N-(iodoacetyl)-N'-(7-nitrobenz-2-oxa-1,3-diazol-4-yl)ethylenediamine
537. The composition according to item 515, wherein the one or more fluorophore label are selected from the group consisting of Oregon Green 488 (difluoro carboxy fluorescein)
538. The composition according to item 515, wherein the one or more fluorophore label are selected from the group consisting of 5-iodoacetamidofluorescein
539. The composition according to item 515, wherein the one or more fluorophore label are selected from the group consisting of propidium iodide-DNA adduct
540. The composition according to item 515, wherein the one or more fluorophore label are selected from the group consisting of Carboxy fluorescein
541. The composition according to any of items 495 to 514, wherein the one or more labels is a fluorescent label.
542. The composition according to item 541, wherein the one or more fluorescent label is a simple fluorescent label
543. The composition according to item 541, wherein the one or more simple fluorescent label is selected from the group Fluor dyes, Pacific Blue™, Pacific Orange™, Cascade Yellow™
544. The composition according to item 541, wherein the one or more simple fluorescent label is selected from the group AlexaFluor®(AF), AF405, AF488, AF500, AF514, AF532, AF546, AF555, AF568, AF594, AF610, AF633, AF635, AF647, AF680, AF700, AF710, AF750, AF800.
545. The composition according to item 541, wherein the one or more simple fluorescent label is selected from the group Quantum Dot based dyes, QDot® Nanocrystals (Invitrogen, MolecularProbs), Qdot®525, Qdot®565, Qdot®585, Qdot®605, Qdot®655, Qdot®705, Qdot®800.
546. The composition according to item 541, wherein the one or more simple fluorescent label is selected from the group DyLight™ Dyes (Pierce) (DL); DL549, DL649, DL680, DL800.
547. The composition according to item 541, wherein the one or more simple fluorescent label is selected from the group Fluorescein (Flu) or any derivate of that, such as FITC
548. The composition according to item 541, wherein the one or more simple fluorescent label is selected from the group Cy-Dyes, Cy2, Cy3, Cy3.5, Cy5, Cy5.5, Cy7.
549. The composition according to item 541, wherein the one or more simple fluorescent label is selected from the group Fluorescent Proteins, RPE, PerCp, APC, Green fluorescent proteins; GFP and GFP derivated mutant proteins; BFP, CFP, YFP, DsRed, T1, Dimer2, mRFP1, MBanana, mOrange, dTomato, tdTomato, mTangerine, mStrawberry, mCherry.
550. The composition according to item 541, wherein the one or more simple fluorescent label is selected from the group Tandem dyes, RPE-Cy5, RPE-Cy5.5, RPE-Cy7, RPE- AlexaFluor® tandem conjugates; RPE-Alexa610, RPE-TxRed, APC-Aleca600, APC-Alexa610, APC-Alexa750, APC-Cy5, APC-Cy5.5.

551. The composition according to item 541, wherein the one or more simple fluorescent label is selected from the group multi fluorochrome assemblies, Multiple fluorochromes attached to a polymer molecule, such as a peptide/protein, Dextrane, polysaccharide, any combination of the fluorescent dyes involving in generation of FRET (Fluorescence resonance energy transfer) based techniques.

552. The composition according to item 541, wherein the one or more simple fluorescent label is selected from the group ionophors; ion chelating fluorescent props, props that change wavelength when binding a specific ion, such as Calcium, props that change intensity when binding to a specific ion, such as Calcium.

553. The composition according to any of items 495 to 514, wherein the one or more labels is capable of absorption of light 554. The composition according to item 553, wherein the one or more labels capable of absorption of light is a chromophore.

555. The composition according to item 553, wherein the one or more labels capable of absorption of light is a dye.

556. The composition according to any of items 495 to 514, wherein the one or more labels is capable of emission of light after excitation 557. The composition according to item 556, wherein the one or more labels capable of emission of light is one or more fluorochromes.

558. The composition according to item 557, wherein the one or more fluorochrome is selected from the AlexaFluor® (AF) family, which include AF®350, AF405, AF430, AF488, AF500, AF514, AF532, AF546, AF555, AF568, AF594, AF610, AF633, AF635, AF647, AF680, AF700, AF710, AF750 and AF800

559. The composition according to item 557, wherein the one or more fluorochrome is selected from the Quantum Dot (Qdot®) based dye family, which include Qdot®525, Qdot®565, Qdot®585, Qdot®605, Qdot®655, Qdot®705, Qdot®800

560. The composition according to item 557, wherein the one or more fluorochrome is selected from the DyLight™ Dyes (DL) family, which include DL549, DL649, DL680, DL800

561. The composition according to item 557, wherein the one or more fluorochrome is selected from the family of Small fluorescing dyes, which include FITC, Pacific Blue™, Pacific Orange™, Cascade Yellow™, Marina Blue™, DSred, DSred-2, 7-AAD, TO-Pro-3.

562. The composition according to item 557, wherein the one or more fluorochrome is selected from the family of Cy-Dyes, which include Cy2, Cy3, Cy3.5, Cy5, Cy5.5, Cy7

563. The composition according to item 557, wherein the one or more fluorochrome is selected from the family of Phycobili Proteins, which include R-Phycoerythrin (RPE), PerCP, Allophycocyanin (APC), B-Phycoerythrin, C-Phycocyanin.

564. The composition according to item 557, wherein the one or more fluorochrome is selected from the family of Fluorescent Proteins, which include (E)GFP and GFP ((enhanced) green fluorescent protein) derived mutant proteins; BFP, CFP, YFP, DsRed, T1, Dimer2, mRFP1, MBanana, mOrange, dTomato, tdTomato, mTangerine.

565. The composition according to item 557, wherein the one or more fluorochrome is selected from the family of Tandem dyes with RPE, which include RPE-Cy5, RPE-Cy5.5, RPE-Cy7, RPE-AlexaFluor® tandem conjugates; RPE-Alexa610, RPE-TxRed.

566. The composition according to item 557, wherein the one or more fluorochrome is selected from the family of Tandem dyes with APC, which include APC-Aleca600, APC-Alexa610, APC-Alexa750, APC-Cy5, APC-Cy5.5.

567. The composition according to item 557, wherein the one or more fluorochrome is selected from the family of Calcium dyes, which include Indo-1-$Ca^{2+}$Indo-2-$Ca^{2+}$.

568. The composition according to any of items 495 to 514, wherein the one or more labels is capable of reflection of light 569. The composition according to item 568, wherein the one or more labels capable of reflection of light comprises gold 570. The composition according to item 568, wherein the one or more labels capable of reflection of light comprises plastic 571. The composition according to item 568, wherein the one or more labels capable of reflection of light comprises glass 572. The composition according to item 568, wherein the one or more labels capable of reflection of light comprises polystyrene 573. The composition according to item 568, wherein the one or more labels capable of reflection of light comprises pollen 574. The composition according to any of items 495 to 514, wherein the one or more labels is a chemiluminescent label.

575. The composition according to item 574, wherein the chemiluminescent labels is selected from the group luminol, isoluminol, theromatic acridinium ester, imidazole, acridinium salt and oxalate ester.

576. The composition according to any of items 495 to 514, wherein the one or more labels is a bioluminescent label.

577. The composition according to item 576, wherein the bioluminescent labels is selected from the group luciferin, luciferase and aequorin.

578. The composition according to any of items 495 to 514, wherein the one or more labels is a radioactive label.

579. The composition according to item 578, wherein the one or more radioactive labels is a radionuclide.

580. The composition according to item 578, wherein the one or more radioactive labels is an isotope.

581. The composition according to item 578, wherein the one or more radioactive labels comprises α rays.

582. The composition according to item 578, wherein the one or more radioactive labels comprises β rays.

583. The composition according to item 578, wherein the one or more radioactive labels comprises γ rays.

584. The composition according to any of items 495 to 514, wherein the one or more labels is detectable by NMR (nuclear magnetic resonance form paramagnetic molecules)

585. The composition according to any of items 495 to 514, wherein the one or more labels is an enzyme label.

586. The composition according to item 585, wherein the enzyme catalyze a reaction between chemicals in the near environment of the labeling molecules, producing a light signal (chemi-luminescence)

587. The composition according to item 585, wherein the enzyme catalyze a reaction between chemicals in the near environment of the labeling molecules, resulting in precipitation of chromophor dyes 588. The composition according to item 585, wherein the enzyme catalyze a reaction between chemicals in the near environment of the labeling molecules, resulting in precipitates that can be detected by an additional layer of detection molecules 589. The composition according to item 585, wherein the enzyme label is selected from the group peroxidases, malate dehydrogenase, staphylococcal nuclease, delta-5-steroid isomerase, yeast alcohol dehydrogenase, alpha-glycerophosphate, dehydrogenase, triose phosphate isomerase, horseradish peroxidase, alkaline phosphatase, asparaginase, glucose oxidase, beta-galactosidase, ribonuclease, urease, catalase, glucose-6-phosphate dehydrogenase, glucoamylase and acetylcholinesterase.

590. The composition according to item 585, wherein the enzyme label is horseradish peroxidase 591. The composition according to item 585, wherein the enzyme label is horseradish peroxidase and the substrate is diaminobenzidine (DAB)

592. The composition according to item 585, wherein the enzyme label is horseradish peroxidase and the substrate is 3-amino-9-ethyl-carbazole (AEC+)

593. The composition according to item 585, wherein the enzyme label is horseradish peroxidase and the substrate is biotinyl tyramide 594. The composition according to item 585, wherein the enzyme label is horseradish peroxidase and the substrate is fluorescein tyramide 595. The composition according to item 585, wherein the enzyme label is alkaline phosphatase 596. The composition according to item 585, wherein the enzyme label is alkaline phosphatase and the substrate is Fast red dye 597. The composition according to any of items 495 to 514, wherein the one or more labels is a ionophore or chelating chemical compound binding to specific ions such as $Ca^{2+}$ 598. The composition according to any of items 495 to 514, wherein the one or more labels is a lanthanide 599. The composition according to item 598, wherein the lanthanide comprises fluorescence 600. The composition according to item 598, wherein the lanthanide comprises Phosphorescence 601. The composition according to item 598, wherein the lanthanide is paramagnetic 602. The composition according to any of items 495 to 514, wherein the one or more labels is a DNA fluorescing stain 603. The composition according to item 602, wherein the DNA fluorescing stain is Propidium iodide 604. The composition according to item 602, wherein the DNA fluorescing stain is Hoechst stain 605. The composition according to item 602, wherein the DNA fluorescing stain is DAPI 606. The composition according to item 602, wherein the DNA fluorescing stain is AMC 607. The composition according to item 602, wherein the DNA fluorescing stain is DraQ5™

608. The composition according to item 602, wherein the DNA fluorescing stain is Acridine orange 609. The composition according to item 457, wherein the MHC-peptide complex (a-b-P) is attached to the first multimerization domain comprising an avidin or streptavidin via a linkage comprising a biotin moiety.

610. The composition according to any of items 457 to 609, wherein the MHC-peptide complex is linked to the first multimerization domain by a first linker moiety.

611. The composition according to item 610, wherein MHC-peptide complex is linked to the first multimerization domain by a covalent linker moiety.

612. The MHC multimer according to items 610 and 611, wherein the association of the first multimerization domain and at least one MHC-peptide complexes is formed by a binding entity X attached to, or being part of, the first multimerization domain, and a binding entity Y attached to, or being part of at least one of the MHC-peptide complexes.

613. The MHC multimer according to items 610 and 611, wherein the linker moiety linking the first multimerization domain and the MHC-peptide complex comprises the linker moiety XY, wherein the linker moiety XY results from a reaction of the moiety X comprising one or more reactive groups and the moiety Y comprising one or more reactive groups, wherein at least some of said reactive groups are capable of reacting with each other.

614. The composition according to item 613, wherein the moiety X comprises a nucleophilic group.

615. The composition according to item 614, wherein the nucleophilic group is selected from the group consisting of —$NH_2$, —OH, —SH, —NH—$NH_2$.

616. The composition according to item 613, wherein the moiety Y comprises an electrophilic group.

617. The composition according to item 616, wherein the electrophilic group is selected from the group consisting of CHO, COOH and CO.

618. The MHC multimer according to items 610 and 611, wherein at least one of the reactive groups on one of the moieties X and Y comprises a radical capable of reacting with a reactive group forming part of the other moiety.

619. The MHC multimer according to items 610 and 611, wherein X and Y comprises reactive groups natively associated with the first multimerization domain and/or the MHC-peptide complexes.

620. The MHC multimer according to items 610 and 611, wherein X and Y comprises reactive groups not natively associated with the first multimerization domain and/or the MHC-peptide complex.

621. The MHC multimer according to items 610 and 611, wherein the linker moiety forms a covalent link between the first multimerization domain and at least one of the MHC-peptide complexes.

622. The MHC multimer according to items 610 and 611, wherein the reactive groups of MHC-peptide complexes include amino acid side chains selected from the group consisting of —$NH_2$, —OH, —SH, and —NH—

623. The MHC multimer according to items 610 and 611, wherein the reactive groups of the first multimerization domain include hydroxyls of polysaccharides such as dextrans 624. The MHC multimer according to items 610 and 611, wherein the reactive groups of the first multimerization domain selected from the group consisting of amino acid side chains comprising —$NH_2$, —OH, —SH, and —NH— of polypeptides 625. The MHC multimer according to items 610 and 611, wherein one of the polypeptides of the MHC-peptide complex is linked by a protein fusion to the first multimerization domain 626. The MHC multimer according to items 610 and 611, wherein one of the polypeptides of the MHC-peptide complex is linked by a protein fusion to the first multimerization domain, wherein an acyl group and an amino group react to form an amide bond 627. The composition according to item 457, wherein one of the polypeptides of the MHC-peptide complex is linked by non-native reactive groups to the first multimerization domain.

628. The composition according to item 457, wherein the reactive groups include reactive groups that are attached to the first multimerization domain through association of a linker molecule comprising the reactive group.
629. The composition according to item 457, wherein the reactive groups include reactive groups that are attached to the MHC-peptide complex through association of a linker molecule comprising the reactive group.
630. The composition according to item 473, wherein dextran is activated by reaction of the dextran hydroxyls with divinyl sulfon
631. The composition according to item 630, wherein dextran is activated by a multistep reaction that results in the decoration of the dextran with maleimide groups.
632. The composition according to item 457, wherein the first multimerization domain comprises one or more nucleophilic groups
633. The composition according to item 632, wherein the nucleophilic group is selected from the group consisting of —$NH_2$, —OH, —SH, —CN, —NH—$NH_2$
634. The composition according to item 457, wherein the first multimerization domain is selected from the group consisting of polysaccharides, polypeptides comprising e.g. lysine, serine, and cysteine.
635. The composition according to item 457, wherein the first multimerization domain comprises one or more electrophilic groups.
636. The composition according to item 635, wherein the electrophilic group is selected from the group consisting of —COOH, —CHO, —CO, NHS-ester, tosyl-activated ester, and other activated esters, acid-anhydrides.
637. The composition according to item 457, wherein the first multimerization domain is selected from the group consisting of polypeptides comprising e.g. glutamate and aspartate, or vinyl sulfone activated dextran.
638. The composition according to item 457, wherein the first multimerization domain comprises one or more radicals.
639. The composition according to item 457, wherein the first multimerization domain comprises one or more conjugated double bonds.
640. The composition according to item 457, wherein the first multimerization domain comprises one or more beads and one or more linker moieties.
641. The MHC multimer according to any of the items 610 to 640, wherein the linker is a flexible linker.
642. The MHC multimer according to any of the items 610 to 640, wherein the linker is a rigid linker.
643. The MHC multimer according to any of the items 610 to 640, wherein the linker is a water-soluble linker.
644. The MHC multimer according to any of the items 610 to 640, wherein the linker is a cleavable linker.
645. The composition according to item 644, wherein the cleavable linker is selected from linkers depicted in (FIG. 2) in PCT/DK2008/050167.
646. The composition according to item 644, wherein the cleavable linker is cleavable at physiological conditions
647. The MHC multimer according to items 610 or 611, wherein the MHC-peptide complex is linked to the first multimerization domain by a non-covalent linker moiety.
648. The composition according to item 647, wherein the non-covalent linkage comprises natural dimerization
649. The composition according to item 648, wherein the natural dimerization comprises antigen-antibody pairs
650. The composition according to item 648, wherein the natural dimerization comprises DNA-DNA interactions
651. The composition according to item 647, wherein the non-covalent linkage comprises natural interactions
652. The composition according to item 651, wherein the natural interaction comprises biotin and streptavidin
653. The composition according to item 481, wherein the bead is coated with streptavidin monomers, which in turn are associated with biotinylated MHC complexes
654. The composition according to item 481, wherein the bead is coated with streptavidin tetramers, each of which being independently associated with 0, 1, 2, 3, or 4 biotinylated MHC complexes
655. The composition according to item 481, wherein the bead is coated with a polysaccharide, such as a polysaccharide comprising dextran moieties.
656. The composition according to item 651, wherein the natural interaction comprises the interaction of MHC complexes (comprising full-length polypeptide chains, including the transmembrane portion) with the cell membrane of for example dendritic cells
657. The composition according to item 651, wherein the non-covalent linkage comprises artificial interactions
658. The composition according to item 657, wherein the artificial interaction comprises $His_6$ tag interacting with Ni-NTA
659. The composition according to item 657, wherein the artificial interaction comprises PNA-PNA
660. The composition according to item 651, wherein the non-covalent linkage comprises non-specific adsorption
661. The composition according to item 660, wherein the non-specific adsorption comprises adsorption of proteins onto surfaces
662. The composition according to item 651, wherein the non-covalent linkage comprises the pentamer structure
663. The composition according to item 651, wherein the non-covalent linkage comprises interactions selected from the group streptavidin/biotin, avidin/biotin, antibody/antigen, DNA/DNA, DNA/PNA, DNA/RNA, PNA/PNA, LNA/DNA, leucine zipper e.g. Fos/Jun, IgG dimeric protein, IgM multivalent protein, acid/base coiled-coil helices, chelate/metal ion-bound chelate, streptavidin (SA) and avidin and derivatives thereof, biotin, immunoglobulins, antibodies (monoclonal, polyclonal, and recombinant), antibody fragments and derivatives thereof, leucine zipper domain of AP-1 (jun and fos), hexa-his (metal chelate moiety), hexa-hat GST (glutathione S-transferase) glutathione affinity, Calmodulin-binding peptide (CBP), Strep-tag, Cellulose Binding Domain, Maltose Binding Protein, S-Peptide Tag, Chitin Binding Tag, Immuno-reactive Epitopes, Epitope Tags, E2Tag, HA Epitope Tag, Myc Epitope, FLAG Epitope, AU1 and AU5 Epitopes, Glu-Glu Epitope, KT3 Epitope, IRS Epitope, Btag Epitope, Protein Kinase-C Epitope, VSV Epitope, lectins that mediate binding to a diversity of compounds, including carbohydrates, lipids and proteins, e.g. Con A (*Canavalia ensiformis*) or WGA (wheat germ agglutinin) and tetranectin or Protein A or G (antibody affinity).
664. The composition according to item 457, wherein the association is a covalent linkage so that one or more of the n MHC-peptide complexes is covalently linked to the second multimerization domains.
665. The composition according to item 457, wherein the association is a non-covalent association so that one or more of the n MHC-peptide complexes is non-covalently associated with the second multimerization domain.
666. The composition according to item 457, wherein the second multimerization domain comprises one or more scaffolds.

667. The composition according to item 457, wherein the second multimerization domain comprises one or more carriers.

668. The composition according to item 457, wherein the second multimerization domain comprises at least one scaffold and at least one carrier.

669. The composition according to item 457, wherein the second multimerization domain comprises one or more optionally substituted organic molecules.

670. The composition according to item 669, wherein the optionally substituted organic molecule comprises one or more functionalized cyclic structures.

671. The composition according to item 670, wherein the one or more functionalized cyclic structures comprises one or more benzene rings.

672. The composition according to item 669, wherein the optionally substituted organic molecule comprises a scaffold molecule comprising at least three reactive groups, or at least three sites suitable for non-covalent attachment.

673. The composition according to item 457, wherein the second multimerization domain comprises one or more biological cells, such as antigen presenting cells or dendritic cells.

674. The composition according to item 457, wherein the second multimerization domain comprises one or more membranes.

675. The composition according to item 674, wherein the one or more membranes comprises liposomes or micelles.

676. The composition according to item 457, wherein the second multimerization domain comprises one or more polymers.

677. The composition according to item 676, wherein the one or more polymers are selected from the group consisting of the group consisting of polysaccharides.

678. The composition according to item 677, wherein the polysaccharide comprises one or more dextran moieties.

679. The composition according to item 457, wherein the second multimerization domain comprises one or more entities selected from the group consisting of an IgG domain, a coiled-coil polypeptide structure, a DNA duplex, a nucleic acid duplex, PNA-PNA, PNA-DNA, DNA-RNA.

680. The composition according to item 457, wherein the second multimerization domain comprises an avidin, such as streptavidin.

681. The composition according to item 457, wherein the second multimerization domain comprises an antibody.

682. The composition according to item 681, wherein the antibody is selected from the group consisting of polyclonal antibody, monoclonal antibody, IgA, IgG, IgM, IgD, IgE, IgG1, IgG2, IgG3, IgG4, IgA1, IgA2, IgM1, IgM2, humanized antibody, humanized monoclonal antibody, chimeric antibody, mouse antibody, rat antibody, rabbit antibody, human antibody, camel antibody, sheep antibody, engineered human antibody, epitope-focused antibody, agonist antibody, antagonist antibody, neutralizing antibody, naturally-occurring antibody, isolated antibody, monovalent antibody, bispecific antibody, trispecific antibody, multispecific antibody, heteroconjugate antibody, immunoconjugates, immunoliposomes, labeled antibody, antibody fragment, domain antibody, nanobody, minibody, maxibody, diabody, fusion antibody.

683. The composition according to item 457, wherein the second multimerization domain comprises one or more small organic scaffold molecules.

684. The composition according to item 457, wherein the second multimerization comprises one or more further polypeptides in addition to a and b.

685. The composition according to item 457, wherein the second multimerization comprises one or more protein complexes.

686. The composition according to item 457, wherein the second multimerization comprises one or more beads 687. The composition according to item 457, wherein the second multimerization domain comprises one or more compounds selected from the group consisting of agarose, sepharose, resin beads, glass beads, pore-glass beads, glass particles coated with a hydrophobic polymer, chitosan-coated beads, SH beads, latex beads, spherical latex beads, allele-type beads, SPA bead, PEG-based resins, PEG-coated bead, PEG-encapsulated bead, polystyrene beads, magnetic polystyrene beads, glutathione agarose beads, magnetic bead, paramagnetic beads, protein A and/or protein G sepharose beads, activated carboxylic acid bead, macroscopic beads, microscopic beads, insoluble resin beads, silica-based resins, cellulosic resins, cross-linked agarose beads, polystyrene beads, cross-linked polyacrylamide resins, beads with iron cores, metal beads, dynabeads, Polymethylmethacrylate beads activated with NHS, streptavidin-agarose beads, polypropylene, polyethylene, dextran, nylon, amylases, natural and modified celluloses, nitrocellulose, polyacrylamides, gabbros, magnetite, polymers, oligomers, non-repeating moieties, polyethylene glycol (PEG), monomethoxy-PEG, mono-($C_1$-$C_{10}$)alkoxy-PEG, aryloxy-PEG, poly-(N-vinyl pyrrolidone)PEG, tresyl monomethoxy PEG, PEG propionaldehyde, bis-succinimidyl carbonate PEG, polystyrene bead crosslinked with divinylbenzene, propylene glycol homopolymers, a polypropylene oxide/ethylene oxide co-polymer, polyoxyethylated polyols (e.g., glycerol), polyvinyl alcohol, dextran, aminodextran, carbohydrate-based polymers, cross-linked dextran beads, polysaccharide beads, polycarbamate beads, divinyl sulfone activated polysaccharide, polystyrene beads that have been functionalized with tosyl-activated esters, magnetic polystyrene beads functionalized with tosyl-activated esters, streptavidin beads, streptaivdin-monomer coated beads, streptaivdin-tetramer coated beads, Streptavidin Coated Compel Magnetic beads, avidin coated beads, dextramer coated beads, divinyl sulfone-activated dextran, Carboxylate-modified bead, amine-modified beads, antibody coated beads, cellulose beads, grafted co-poly beads, poly-acrylamide beads, dimethylacrylamide beads optionally cross-linked with N—N'-bis-acryloylethylenediamine, hollow fiber membranes, fluorescent beads, collagen-agarose beads, gelatin beads, collagen-gelatin beads, collagen-fibronectin-gelatin beads, collagen beads, chitosan beads, collagen-chitosan beads, protein-based beads, hydrogel beads, hemicellulose, alkyl cellulose, hydroxyalkyl cellulose, carboxymethylcellulose, sulfoethylcellulose, starch, xylan, amylopectine, chondroitin, hyarulonate, heparin, guar, xanthan, mannan, galactomannan, chitin and chitosan.

688. The composition according to item 457, wherein the second multimerization domain comprises a dimerization domain.

689. The composition according to item 457, wherein the second multimerization domain comprises a trimerization domain.

690. The composition according to item 457, wherein the second multimerization domain comprises a tetramerization domain.

691. The composition according to item 457, wherein the second multimerization domain comprises a pentamerization domain.

692. The composition according to item 691, wherein the pentamerization domain comprises a coiled-coil polypeptide structure.

693. The composition according to item 457, wherein the second multimerization domain comprises a hexamerization domain.

694. The composition according to item 610, wherein the hexamerization domain comprises three IgG domains.

695. The composition according to item 457, wherein the second multimerization domain comprises a polymer structure to which is attached one or more scaffolds.

696. The composition according to item 695, wherein the polymer structure comprises a polysaccharide.

697. The composition according to item 696, wherein the polysaccharide comprises one or more dextran moieties.

698. The composition according to item 457, wherein the second multimerization domain comprises a polyamide and/or a polyethylene glycol and/or a polysaccharide and/or a sepharose.

699. The composition according to item 457, wherein the second multimerization domain comprises a carboxy methyl dextran and/or a dextran polyaldehyde and/or a carboxymethyl dextran lactone and/or a cyclodextrin.

700. The composition according to item 457, wherein one or more labels is covalently attached to the second multimerization domain.

701. The composition according to item 457, wherein one or more labels is non-covalently attached to the second multimerization domain.

702. The composition according to item 701, wherein the one or more labels is non-covalently attached to an antibody in the second mutimerization domain.

703. The composition according to item 700, wherein the one or more labels is covalently attached to an antibody in the second mutimerization domain.

704. The composition according to item 701, wherein the one or more labels is non-covalently attached to an aptamer in the second mutimerization domain.

705. The composition according to item 700, wherein the one or more labels is covalently attached to an aptamer in the second multimerization domain.

706. The composition according to item 701, wherein the one or more labels is non-covalently attached to a molecule in the second mutimerization domain.

707. The composition according to item 700, wherein the one or more labels is covalently attached to a molecule in the second mutimerization domain.

708. The composition according to item 701, wherein the one or more labels is non-covalently attached to a protein in the second mutimerization domain.

709. The composition according to item 700, wherein the one or more labels is covalently attached to a protein in the second multimerization domain.

710. The composition according to item 701, wherein the one or more labels is non-covalently attached to a sugar residue in the second mutimerization domain.

711. The composition according to item 700, wherein the one or more labels is covalently attached to a sugar residue in the second multimerization domain.

712. The composition according to item 701, wherein the one or more labels is non-covalently attached to a DNA in the second multimerization domain.

713. The composition according to item 700, wherein the one or more labels is covalently attached to a DNA in the second mutimerization domain.

714. The MHC multimer according to any of the items 700 to 713, wherein the attachment is directly between reactive groups in the labelling molecule and reactive groups in the marker molecule.

715. The MHC multimer according to any of the items 700 to 713, wherein the attachment is through a linker connecting labelling molecule and marker.

716. The MHC multimer according to any of the items 700 to 713, wherein one label is used.

717. The MHC multimer according to any of the items 700 to 713, wherein more than one label is used.

718. The composition according to item 717, wherein the more than one label are all identical.

719. The composition according to item 717, wherein at least two labels are different.

720. The composition according to any of items 700 to 719, wherein the one or more labels is a fluorophore.

721. The composition according to item 720, wherein the one or more fluorophore label are selected from the group consisting of selected from the group fluorescein isothiocyanate, rhodamine, phycoerythrin, phycocyanin, allophycocyanin, o-phthaldehyde and fluorescamine.

722. The composition according to item 720, wherein the one or more fluorophore label are selected from the group consisting of 2-(4'-maleimidylanilino)naphthalene-6-sulfonic acid, sodium salt 723. The composition according to item 720, wherein the one or more fluorophore label are selected from the group consisting of 5-((((2-iodoacetyl)amino)ethyl)amino) naphthalene-1-sulfonic acid 724. The composition according to item 720, wherein the one or more fluorophore label are selected from the group consisting of Pyrene-1-butanoic acid 725. The composition according to item 720, wherein the one or more fluorophore label are selected from the group consisting of AlexaFluor 350 (7-amino-6-sulfonic acid-4-methyl coumarin-3-acetic acid 726. The composition according to item 720, wherein the one or more fluorophore label are selected from the group consisting of AMCA (7-amino-4-methyl coumarin-3-acetic acid 727. The composition according to item 720, wherein the one or more fluorophore label are selected from the group consisting of 7-hydroxy-4-methyl coumarin-3-acetic acid 728. The composition according to item 720, wherein the one or more fluorophore label are selected from the group consisting of Marina Blue (6,8-difluoro-7-hydroxy-4-methyl coumarin-3-acetic acid 729. The composition according to item 720, wherein the one or more fluorophore label are selected from the group consisting of 7-dimethylamino-coumarin-4-acetic acid 730. The composition according to item 720, wherein the one or more fluorophore label are selected from the group consisting of Fluorescamin-N-butyl amine adduct 731. The composition according to item 720, wherein the one or more fluorophore label are selected from the group consisting of 7-hydroxy-coumarine-3-carboxylic acid 732. The composition according to item 720, wherein the one or more fluorophore label are selected from the group consisting of CascadeBlue (pyrene-trisulphonic acid acetyl azide 733. The composition according to item 720, wherein the one or more fluorophore label are selected from the group consisting of Cascade Yellow 734. The composition according to item 720, wherein the one or more fluorophore label are selected from the group consisting of Pacific Blue (6,8 difluoro-7-hydroxy coumarin-3-carboxylic acid 735. The composition according to item 720, wherein the one or more fluorophore label are selected from the group consisting of 7-diethylamino-coumarin-3-carboxylic acid 736. The composition according to item 720, wherein the one or more fluorophore label are selected from the group consisting of N-(((4-azidobenzoyl)amino)ethyl)-4-amino-3, 6-disulfo-1,8-naphthalimide, dipotassium salt 737. The composition according to item 720, wherein the one or more fluorophore label are selected from the group consisting of Alexa Fluor 430

738. The composition according to item 720, wherein the one or more fluorophore label are selected from the group consisting of 3-perylenedodecanoic acid 739. The composition according to item 720, wherein the one or more fluorophore label are selected from the group consisting of 8-hydroxypyrene-1,3,6-trisulfonic acid, trisodium salt 740. The composition according to item 720, wherein the one or more fluorophore label are selected from the group consisting of 12-(N-(7-nitrobenz-2-oxa-1,3-diazol-4-yl)amino)dodecanoic acid 741. The composition according to item 720, wherein the one or more fluorophore label are selected from the group consisting of N,N'-dimethyl-N-(iodoacetyl)-N'-(7-nitrobenz-2-oxa-1,3-diazol-4-yl)ethylenediamine 742. The composition according to item 720, wherein the one or more fluorophore label are selected from the group consisting of Oregon Green 488 (difluoro carboxy fluorescein)

743. The composition according to item 720, wherein the one or more fluorophore label are selected from the group consisting of 5-iodoacetamidofluorescein 744. The composition according to item 720, wherein the one or more fluorophore label are selected from the group consisting of propidium iodide-DNA adduct 745. The composition according to item 720, wherein the one or more fluorophore label are selected from the group consisting of Carboxy fluorescein 746. The composition according to any of items 700 to 719, wherein the one or more labels is a fluorescent label.

747. The composition according to item 746, wherein the one or more fluorescent label is a simple fluorescent label 748. The composition according to item 747, wherein the one or more simple fluorescent label is selected from the group Fluor dyes, Pacific Blue™, Pacific Orange™, Cascade Yellow™

749. The composition according to item 747, wherein the one or more simple fluorescent label is selected from the group AlexaFluor®(AF), AF405, AF488, AF500, AF514, AF532, AF546, AF555, AF568, AF594, AF610, AF633, AF635, AF647, AF680, AF700, AF710, AF750, AF800.

750. The composition according to item 747, wherein the one or more simple fluorescent label is selected from the group Quantum Dot based dyes, QDot® Nanocrystals (Invitrogen, MolecularProbs), Qdot®525, Qdot®565, Qdot®585, Qdot®605, Qdot®655, Qdot®705, Qdot®800.

751. The composition according to item 747, wherein the one or more simple fluorescent label is selected from the group DyLight™ Dyes (Pierce) (DL); DL549, DL649, DL680, DL800.

752. The composition according to item 747, wherein the one or more simple fluorescent label is selected from the group Fluorescein (Flu) or any derivate of that, such as FITC 753. The composition according to item 747, wherein the one or more simple fluorescent label is selected from the group Cy-Dyes, Cy2, Cy3, Cy3.5, Cy5, Cy5.5, Cy7.

754. The composition according to item 747, wherein the one or more simple fluorescent label is selected from the group Fluorescent Proteins, RPE, PerCp, APC, Green fluorescent proteins; GFP and GFP derivated mutant proteins; BFP, CFP, YFP, DsRed, T1, Dimer2, mRFP1, MBanana, mOrange, dTomato, tdTomato, mTangerine, mStrawberry, mCherry.

755. The composition according to item 747, wherein the one or more simple fluorescent label is selected from the group Tandem dyes, RPE-Cy5, RPE-Cy5.5, RPE-Cy7, RPE-AlexaFluor® tandem conjugates; RPE-Alexa610, RPE-TxRed, APC-Aleca600, APC-Alexa610, APC-Alexa750, APC-Cy5, APC-Cy5.5.

756. The composition according to item 747, wherein the one or more simple fluorescent label is selected from the group multi fluorochrome assemblies, Multiple fluorochromes attached to a polymer molecule, such as a peptide/protein, Dextrane, polysaccharide, any combination of the fluorescent dyes involving in generation of FRET (Fluorescence resonance energy transfer) based techniques.

757. The composition according to item 747, wherein the one or more simple fluorescent label is selected from the group ionophors; ion chelating fluorescent props, props that change wavelength when binding a specific ion, such as Calcium, props that change intensity when binding to a specific ion, such as Calcium.

758. The composition according to any of items 700 to 719, wherein the one or more labels is capable of absorption of light 759. The composition according to item 758, wherein the one or more labels capable of absorption of light is a chromophore.

760. The composition according to item 758, wherein the one or more labels capable of absorption of light is a dye.

761. The composition according to any of items 700 to 719, wherein the one or more labels is capable of emission of light after excitation 762. The composition according to item 761, wherein the one or more labels capable of emission of light is one or more fluorochromes.

763. The composition according to item 762, wherein the one or more fluorochrome is selected from the AlexaFluor® (AF) family, which include AF®350, AF405, AF430, AF488, AF500, AF514, AF532, AF546, AF555, AF568, AF594, AF610, AF633, AF635, AF647, AF680, AF700, AF710, AF750 and AF800

764. The composition according to item 762, wherein the one or more fluorochrome is selected from the Quantum Dot (Qdot®) based dye family, which include Qdot®525, Qdot®565, Qdot®585, Qdot®605, Qdot®655, Qdot®705, Qdot®800

765. The composition according to item 762, wherein the one or more fluorochrome is selected from the DyLight™ Dyes (DL) family, which include DL549, DL649, DL680, DL800

766. The composition according to item 762, wherein the one or more fluorochrome is selected from the family of Small fluorescing dyes, which include FITC, Pacific Blue™, Pacific Orange™, Cascade Yellow™, Marina Blue™, DSred, DSred-2, 7-AAD, TO-Pro-3.

767. The composition according to item 762, wherein the one or more fluorochrome is selected from the family of Cy-Dyes, which include Cy2, Cy3, Cy3.5, Cy5, Cy5.5, Cy7

768. The composition according to item 762, wherein the one or more fluorochrome is selected from the family of Phycobili Proteins, which include R-Phycoerythrin (RPE), PerCP, Allophycocyanin (APC), B-Phycoerythrin, C-Phycocyanin.
769. The composition according to item 762, wherein the one or more fluorochrome is selected from the family of Fluorescent Proteins, which include (E)GFP and GFP ((enhanced) green fluorescent protein) derived mutant proteins; BFP, CFP, YFP, DsRed, T1, Dimer2, mRFP1, MBanana, mOrange, dTomato, tdTomato, mTangerine.
770. The composition according to item 762, wherein the one or more fluorochrome is selected from the family of Tandem dyes with RPE, which include RPE-Cy5, RPE-Cy5.5, RPE-Cy7, RPE-AlexaFluor® tandem conjugates; RPE-Alexa610, RPE-TxRed.
771. The composition according to item 762, wherein the one or more fluorochrome is selected from the family of Tandem dyes with APC, which include APC-Aleca600, APC-Alexa610, APC-Alexa750, APC-Cy5, APC-Cy5.5.
772. The composition according to item 762, wherein the one or more fluorochrome is selected from the family of Calcium dyes, which include Indo-1-$Ca^{2+}$ Indo-2-$Ca^{2+}$.
773. The composition according to any of items 700 to 719, wherein the one or more labels is capable of reflection of light
774. The composition according to item 773, wherein the one or more labels capable of reflection of light comprises gold
775. The composition according to item 773, wherein the one or more labels capable of reflection of light comprises plastic
776. The composition according to item 773, wherein the one or more labels capable of reflection of light comprises glass
777. The composition according to item 773, wherein the one or more labels capable of reflection of light comprises polystyrene
778. The composition according to item 773, wherein the one or more labels capable of reflection of light comprises pollen
779. The composition according to any of items 700 to 719, wherein the one or more labels is a chemiluminescent label.
780. The composition according to item 779, wherein the chemiluminescent labels is selected from the group luminol, isoluminol, theromatic acridinium ester, imidazole, acridinium salt and oxalate ester.
781. The composition according to any of items 700 to 719, wherein the one or more labels is a bioluminescent label.
782. The composition according to item 781, wherein the bioluminescent labels is selected from the group consisting of luciferin, luciferase and aequorin.
783. The composition according to any of items 700 to 719, wherein the one or more labels is a radioactive label.
784. The composition according to item 783, wherein the one or more radioactive labels is a radionuclide.
785. The composition according to item 783, wherein the one or more radioactive labels is an isotope.
786. The composition according to item 783, wherein the one or more radioactive labels comprises α rays.
787. The composition according to item 783, wherein the one or more radioactive labels comprises β rays.
788. The composition according to item 783, wherein the one or more radioactive labels comprises γ rays.
789. The composition according to any of items 700 to 719, wherein the one or more labels is detectable by NMR (nuclear magnetic resonance form paramagnetic molecules)
790. The composition according to any of items 700 to 719, wherein the one or more labels is an enzyme label.
791. The composition according to item 790, wherein the enzyme catalyze a reaction between chemicals in the near environment of the labeling molecules, producing a light signal (chemi-luminescence)
792. The composition according to item 790, wherein the enzyme catalyze a reaction between chemicals in the near environment of the labeling molecules, resulting in precipitation of chromophor dyes
793. The composition according to item 790, wherein the enzyme catalyze a reaction between chemicals in the near environment of the labeling molecules, resulting in precipitates that can be detected by an additional layer of detection molecules
794. The composition according to item 790, wherein the enzyme label is selected from the group peroxidases, malate dehydrogenase, staphylococcal nuclease, delta-5-steroid isomerase, yeast alcohol dehydrogenase, alpha-glycerophosphate, dehydrogenase, triose phosphate isomerase, horseradish peroxidase, alkaline phosphatase, asparaginase, glucose oxidase, beta-galactosidase, ribonuclease, urease, catalase, glucose-6-phosphate dehydrogenase, glucoamylase and acetylcholinesterase.
795. The composition according to item 790, wherein the enzyme label is horseradish peroxidase
796. The composition according to item 790, wherein the enzyme label is horseradish peroxidase and the substrate is diaminobenzidine (DAB)
797. The composition according to item 790, wherein the enzyme label is horseradish peroxidase and the substrate is 3-amino-9-ethyl-carbazole (AEC+)
798. The composition according to item 790, wherein the enzyme label is horseradish peroxidase and the substrate is biotinyl tyramide
799. The composition according to item 790, wherein the enzyme label is horseradish peroxidase and the substrate is fluorescein tyramide
800. The composition according to item 790, wherein the enzyme label is alkaline phosphatase
801. The composition according to item 790, wherein the enzyme label is alkaline phosphatase and the substrate is Fast red dye
802. The composition according to any of items 700 to 719, wherein the one or more labels is a ionophore or chelating chemical compound binding to specific ions such as $Ca^{2+}$
803. The composition according to any of items 700 to 719, wherein the one or more labels is a lanthanide
804. The composition according to item 803, wherein the lanthanide comprises fluorescence
805. The composition according to item 803, wherein the lanthanide comprises Phosphorescence
806. The composition according to item 803, wherein the lanthanide is paramagnetic
807. The composition according to any of items 700 to 719, wherein the one or more labels is a DNA fluorescing stain
808. The composition according to item 807, wherein the DNA fluorescing stain is Propidium iodide
809. The composition according to item 807, wherein the DNA fluorescing stain is Hoechst stain
810. The composition according to item 807, wherein the DNA fluorescing stain is DAPI
811. The composition according to item 807, wherein the DNA fluorescing stain is AMC
812. The composition according to item 807, wherein the DNA fluorescing stain is DraQ5™

813. The composition according to item 807, wherein the DNA fluorescing stain is Acridine orange 814. The composition according to item 457, wherein the MHC-peptide complex (a-b-P) is attached to the second multimerization domain comprising an avidin or streptavidin via a linkage comprising a biotin moiety.

815. The composition according to any of items 457 to 814, wherein the MHC-peptide complex is linked to the second multimerization domain by a second linker moiety.

816. The composition according to item 815, wherein the MHC-peptide complex is linked to the second multimerization domain by a covalent linker moiety.

817. The MHC multimer according to items 814 and 815, wherein the linkage of the second multimerization domain and at least one MHC-peptide complexes is formed by a binding entity X attached to, or being part of, the second multimerization domain, and a binding entity Y attached to, or being part of at least one of the MHC-peptide complexes.

818. The MHC multimer according to items 814 and 815, wherein the linker moiety linking the second multimerization domain and the MHC-peptide complex comprises the linker moiety XY, wherein the linker moiety XY results from a reaction of the moiety X comprising one or more reactive groups and the moiety Y comprising one or more reactive groups, wherein at least some of said reactive groups are capable of reacting with each other.

819. The composition according to item 818, wherein the moiety X comprises a nucleophilic group.

820. The composition according to item 819, wherein the nucleophilic group is selected from the group consisting of —$NH_2$, —OH, —SH, —NH—$NH_2$.

821. The composition according to item 818, wherein the moiety Y comprises an electrophilic group.

822. The composition according to item 821, wherein the electrophilic group is selected from the group consisting of CHO, COOH and CO.

823. The MHC multimer according to items 814 and 815, wherein at least one of the reactive groups on one of the moieties X and Y comprises a radical capable of reacting with a reactive group forming part of the other moiety.

824. The MHC multimer according to items 814 and 815, wherein X and Y comprises reactive groups natively associated with the second multimerization domain and/or the MHC-peptide complexes.

825. The MHC multimer according to items 814 and 815, wherein X and Y comprises reactive groups not natively associated with the second multimerization domain and/or the MHC-peptide complex.

826. The MHC multimer according to items 814 and 815, wherein the linker moiety forms a covalent link between the second multimerization domain and at least one of the MHC-peptide complexes.

827. The MHC multimer according to items 814 and 815, wherein the reactive groups of MHC-peptide complexes include amino acid side chains selected from the group consisting of —$NH_2$, —OH, —SH, and —NH—

828. The MHC multimer according to items 814 and 815, wherein the reactive groups of the second multimerization domain include hydroxyls of polysaccharides such as dextrans 829. The MHC multimer according to items 814 and 815, wherein the reactive groups of the second multimerization domain selected from the group consisting of amino acid side chains comprising —$NH_2$, —OH, —SH, and —NH— of polypeptides 830. The MHC multimer according to items 814 and 815, wherein one of the polypeptides of the MHC-peptide complex is linked by a protein fusion to the second multimerization domain 831. The MHC multimer according to items 814 and 815, wherein one of the polypeptides of the MHC-peptide complex is linked by a protein fusion to the second multimerization domain, wherein an acyl group and an amino group react to form an amide bond 832. The composition according to item 457, wherein one of the polypeptides of the MHC-peptide complex is linked by non-native reactive groups to the second multimerization domain.

833. The composition according to item 457, wherein the reactive groups include reactive groups that are attached to the second multimerization domain through association of a linker molecule comprising the reactive group.

834. The composition according to item 457, wherein the reactive groups include reactive groups that are attached to the MHC-peptide complex through association of a linker molecule comprising the reactive group.

835. The composition according to item 473, wherein dextran is activated by reaction of the dextran hydroxyls with divinyl sulfon 836. The composition according to item 835, wherein dextran is activated by a multistep reaction that results in the decoration of the dextran with maleimide groups.

837. The composition according to item 457, wherein the second multimerization domain comprises one or more nucleophilic groups 838. The composition according to item 837, wherein the nucleophilic group is selected from the group consisting of —$NH_2$, —OH, —SH, —CN, —NH—$NH_2$ 839. The composition according to item 457, wherein the second multimerization domain is selected from the group consisting of polysaccharides, polypeptides comprising e.g. lysine, serine, and cysteine.

840. The composition according to item 457, wherein the second multimerization domain comprises one or more electrophilic groups.

841. The composition according to item 840, wherein the electrophilic group is selected from the group consisting of —COOH, —CHO, —CO, NHS-ester, tosyl-activated ester, and other activated esters, acid-anhydrides.

842. The composition according to item 457, wherein the second multimerization domain is selected from the group consisting of polypeptides comprising e.g. glutamate and aspartate, or vinyl sulfone activated dextran.

843. The composition according to item 457, wherein the second multimerization domain comprises one or more radicals.

844. The composition according to item 457, wherein the second multimerization domain comprises one or more conjugated double bonds.

845. The composition according to item 457, wherein the second multimerization domain comprises one or more beads and one or more linker moieties.

846. The MHC multimer according to any of the items 814 to 845, wherein the linker is a flexible linker.

847. The MHC multimer according to any of the items 814 to 845, wherein the linker is a rigid linker.

848. The MHC multimer according to any of the items 814 to 845, wherein the linker is a water-soluble linker.

849. The MHC multimer according to any of the items 814 to 845, wherein the linker is a cleavable linker.

850. The composition according to item 849, wherein the cleavable linker is selected from linkers depicted in (FIG. 2) in PCT/DK2008/050167.
851. The composition according to item 849, wherein the cleavable linker is cleavable at physiological conditions
852. The MHC multimer according to items 814 and 815, wherein the MHC-peptide complex is linked to the second multimerization domain by a non-covalent linker moiety.
853. The composition according to item 852, wherein the non-covalent linkage comprises natural dimerization
854. The composition according to item 853, wherein the natural dimerization comprises antigen-antibody pairs
855. The composition according to item 853, wherein the natural dimerization comprises DNA-DNA interactions
856. The composition according to item 852, wherein the non-covalent linkage comprises natural interactions
857. The composition according to item 856, wherein the natural interaction comprises biotin and streptavidin
858. The composition according to item 686, wherein the bead is coated with streptavidin monomers, which in turn are associated with biotinylated MHC complexes
859. The composition according to item 686, wherein the bead is coated with streptavidin tetramers, which in turn are associated with 0, 1, 2, 3, or 4 biotinylated MHC complexes
860. The composition according to item 686, wherein the bead is coated with a polysaccharide, such as a polysaccharide comprising a dextran moiety.
861. The composition according to item 856, wherein the natural interaction comprises the interaction of MHC complexes (comprising full-length polypeptide chains, including the transmembrane portion) with the cell membrane of for example dendritic cells
862. The composition according to item 852, wherein the non-covalent linkage comprises artificial interactions
863. The composition according to item 862, wherein the artificial interaction comprises $His_6$ tag interacting with Ni-NTA
864. The composition according to item 862, wherein the artificial interaction comprises PNA-PNA
865. The composition according to item 852, wherein the non-covalent linkage comprises non-specific adsorption
866. The composition according to item 865, wherein the non-specific adsorption comprises adsorption of proteins onto surfaces
867. The composition according to item 852, wherein the non-covalent linkage comprises the pentamer structure
868. The composition according to item 867, wherein the non-covalent linkage comprises interactions selected from the group streptavidin/biotin, avidin/biotin, antibody/antigen, DNA/DNA, DNA/PNA, DNA/RNA, PNA/PNA, LNA/DNA, leucine zipper e.g. Fos/Jun, IgG dimeric protein, IgM multivalent protein, acid/base coiled-coil helices, chelate/metal ion-bound chelate, streptavidin (SA) and avidin and derivatives thereof, biotin, immunoglobulins, antibodies (monoclonal, polyclonal, and recombinant), antibody fragments and derivatives thereof, leucine zipper domain of AP-1 (jun and fos), hexa-his (metal chelate moiety), hexa-hat GST (glutathione S-transferase) glutathione affinity, Calmodulin-binding peptide (CBP), Strep-tag, Cellulose Binding Domain, Maltose Binding Protein, S-Peptide Tag, Chitin Binding Tag, Immuno-reactive Epitopes, Epitope Tags, E2Tag, HA Epitope Tag, Myc Epitope, FLAG Epitope, AU1 and AU5 Epitopes, Glu-Glu Epitope, KT3 Epitope, IRS Epitope, Btag Epitope, Protein Kinase-C Epitope, VSV Epitope, lectins that mediate binding to a diversity of compounds, including carbohydrates, lipids and proteins, e.g. Con A (*Canavalia ensiformis*) or WGA (wheat germ agglutinin) and tetranectin or Protein A or G (antibody affinity).
869. The composition according to item 1, wherein the one or more pharmamers comprises one or more organic molecule-based pharmamers.
870. The composition according to item 1, wherein the one or more pharmamers comprises one or more functionalized cyclic structures such as benzene rings where e.g. a benzene ring is functionalized and covalently linked to e.g. three immunologically active molecules.
871. The composition according to item 1, wherein the one or more pharmamers comprises one or more cell-based pharmamers.
872. The composition according to item 1, wherein the one or more pharmamers comprises one or more dendritic cells and/or one or more antigen presenting cells (APCs).
873. The composition according to item 1, wherein the one or more pharmamers comprises one or more membrane-based pharmamers.
874. The composition according to item 1, wherein the one or more pharmamers comprises one or more liposomes and/or micelles e.g. carrying immunologically active molecules or complexes in their membranes.
875. The composition according to item 1, wherein the one or more pharmamers comprises one or more polymer-based pharmamers.
876. The composition according to item 1, wherein the one or more pharmamers comprises one or more molecule constructs where immunologically active molecules or complexes are bound covalently or non-covalently to a dextran.
877. The composition according to item 1, wherein the one or more pharmamers comprises one or more backbone/multimerisation domain(s).
878. The composition according to item 1, wherein the one or more pharmamers comprises one or more particles such as beads.
879. The composition according to item 1, wherein the one or more pharmamers comprises one or more solid supports with immunologically active molecules immobilized on the surface.
880. The composition according to item 1, wherein the one or more pharmamers comprises one or more multimerization domain(s) such as one or more cells, polymers, proteins or other molecular structures, or particles and solid supports.
881. The composition according to item 1, wherein the one or more pharmamers comprises one or more pharmamers in solid form and/or one or more pharmamers in insoluble form and/or one or more pharmamers in soluble form and/or one or more pharmamers in suspension.
882. The composition according to item 1, wherein the one or more pharmamers comprises one or more biologically active molecules and one or more multimerization domain (s).
883. The composition according to item 882, wherein the one or more biologically active molecules comprises one or more molecules with adjuvant effects.
884. The composition according to item 882, wherein the one or more biologically active molecules comprises one or more immune targets e.g. antigens.
885. The composition according to item 882, wherein the one or more biologically active molecules comprises one or more molecules with biological activity e.g. enzymes.
886. The composition according to item 882, wherein the one or more biologically active molecules comprises one or more regulators of receptor activity.

887. The composition according to item 882, wherein the one or more biologically active molecules comprises one or more receptor ligands.
888. The composition according to item 882, wherein the one or more biologically active molecules comprises one or more immune potentiators.
889. The composition according to item 882, wherein the one or more biologically active molecules comprises one or more drugs.
890. The composition according to item 882, wherein the one or more biologically active molecules comprises one or more toxins.
891. The composition according to item 882, wherein the one or more biologically active molecules comprises one or more co-receptors.
892. The composition according to item 882, wherein the one or more biologically active molecules comprises one or more proteins.
893. The composition according to item 882, wherein the one or more biologically active molecules comprises one or more peptides.
894. The composition according to item 882, wherein the one or more biologically active molecules comprises one or more sugar moieties.
895. The composition according to item 882, wherein the one or more biologically active molecules comprises one or more lipid groups.
896. The composition according to item 882, wherein the one or more biologically active molecules comprises one or more nucleic acids including siRNA and microRNA.
897. The composition according to item 882, wherein the one or more biologically active molecules comprises one or more nano particles.
898. The composition according to item 882, wherein the one or more biologically active molecules comprises one or more small molecules.
899. The composition according to item 882, wherein the one or more biologically active molecules comprises one or more membranes.
900. The composition according to item 882, wherein the one or more biologically active molecules comprises one or more liposomes.
901. The composition according to item 882, wherein the one or more biologically active molecules comprises one or more immunological active molecules.
902. The composition according to item 882, wherein the one or more biologically active molecules comprises more than one identical immunological active molecules.
903. The composition according to item 882, wherein the one or more biologically active molecules comprises more than one different immunological active molecules.
904. The composition according to item 901, wherein the one or more immunological active molecules comprises one or more biological active molecules including proteins, co-stimulatory molecules, cell modulating molecules, receptors, accessory molecules, adhesion molecules, natural ligands, and toxic molecules, as well as antibodies and recombinant binding molecules to any of the foregoing, and combinations thereof.
905. The composition according to item 901, wherein the one or more immunological active molecules comprises one or more molecule(s) selected from the group consisting of MHC Class 1 proteins like HLA-A, HLA-B, HLA-C alone or in complex with HLA-b2Microglobulin with or without peptide in the binding groove.
906. The composition according to item 901, wherein the one or more immunological active molecules comprises one or more molecule(s) selected from the group consisting of Class 1-like proteins like MICA, MICB, CD1d, HLA-E, HLA-F, HLA-G, HLA-H, ULBP-1, ULBP-2, and ULBP-3.
907. The composition according to item 901, wherein the one or more immunological active molecules comprises one or more molecule(s) selected from the group consisting of HLA class 2 proteins like HLA-DR (HLA-DRA, HLA-DRB1, HLA-DRB3, HLA-DRB4, HLA-DRB5), HLA-DQ (HLA-DQA1, HLADQA2, HLA-DQB1, HLA-DQB2), HLA-DP (HLA-DPA1, HLA-DPB1), HLA-DO (HLA-DOA, HLA-DOB), HLA-DM (HLA-DMA, HLA-DMB) alone or in complexes consisting of class 2 A- and B-chains with or without peptide in the binding groove.
908. The composition according to item 901, wherein the one or more immunological active molecules comprises one or more molecule(s) selected from the group consisting of Cytokines; IFN-alpha, IFN-beta, IFN-gamma, IL-1, IL-2, IL-3, IL-4, IL-6, IL-7, IL-8, IL-10, IL-11, IL-12, IL-15, IL-16, IL-17, IL-18, IL-19, IL-20, IL-21, IL-22, IL-23, IL-24, IL-25, IL-26, IL-27, IL-28, -IL-29, IL-30, IL-31, IL-32, IL-33, IL-34, IL-35, CSFs (colony-stimulating factors), c-Kit, EPO, TNF-alfa, TNF-beta, Lymphotoxin; Cytokine receptors like IL-1R, IL-2R, IL-3R, IL-4R, IL-5R, IL-6R, IL-7R, IL-8R, IL-9-R, IL-10R, IL-11R, IL-12R, IL-13R, IL-15R, IL-18R, IL-20R, IL-21R, IL-22R, IL-23R, IL-27R, IL-28R; Chemokines such as CXCL1, CXCL2, CXCL3, CXCL4, CXCL5, CXCL6, CXCL7, CXCL8, CXCL9, CXCL10, CXCL11, CXCL12, CXCL13, CXCL14, CXCL15, CXCL16, CCL1, CCL2, CCL3, CCL4, CCL5, CCL6, CCL7, CCL8, CCL8, CCL9, CCL10, CCL11, CCL12, CCL13, CCL14, CCL15, CCL16, CCL17, CCL18, CCL19, CCL20, CCL21, CCL22, CCL23, CCL24, CCL25, CCL26, CCL27, CCL28, CXCR4, CCRL2; Chemokine receptors like CCR1, CCR2, CCR3, CCR4, CCR5, CCR6, CCR7, CCR8, CCR9, CCR10, CCR11, CXCR1, CXCR2, CXCR3, CXCR4, CXCR5, CXCR6, CXCR7, and CX3CR1.
909. The composition according to item 901, wherein the one or more immunological active molecules comprises one or more molecule(s) selected from the group consisting of Toll-like receptors such as TLR1, TLR2, TLR3, TLR4, TLR5, TLR6, TLR7, TLR8, TLR9, and TLR10.
910. The composition according to item 901, wherein the one or more immunological active molecules comprises one or more molecule(s) selected from the group consisting of Toll like receptor ligands such as multiple triacyl lipopeptides, multiple diacyl lipopeptides, multiple glycolipids, multiple lipopeptides, multiple lipoproteins, lipoteichoic acid, peptidoglycans, heat shock proteins (HSP70, HSP90 and others), zymosan, single- and double-stranded RNA, Poly I:C, lipo-polysaccharides, fibrinogen, heparin sulphate fragments, hyaluronic acid fragments, flagellin, imidazoquinoline, loxoribine (guanosine analogue), bropirimine, Imiquimod, unmethylated CpG DNA.
911. The composition according to item 901, wherein the one or more immunological active molecules comprises one or more molecule(s) selected from the group consisting of Viral entry receptors/molecules such as Ku70, Pvr, Prr1, HVEM, EphrinB2, cellular integrins (in particular alpha2beta1, alpha6beta1 alphaVbeta3), CD81, CD155, SR-B1, claudin-1, xCT, human nectin-2, LIGHT, TLR3, LIR, Heparan sulphate proteoglycans, GPI anchored proteins, hemeagglutinin receptor.
912. The composition according to item 901, wherein the one or more immunological active molecules comprises one or more molecule(s) selected from the group consisting of Bacterial entry receptors/molecules like CD48, CEACAM-1, -2, -3, -4, -5, -6, invasion, internalin (InlA), InlB; Fc receptors like ε (FcεRI, FcεRII)—γ (FcγRI, FcγRII, FcγRIII)—α/μ (FcαRI, Fcα/μR)—Neonatal FcR.

913. The composition according to item 901, wherein the one or more immunological active molecules comprises one or more molecule(s) selected from the group consisting of Lymphocyte homing receptors such as CD44, L-selectin, VLA-4 (CD49a, b, c, d, e, f), LFA-1.

914. The composition according to item 901, wherein the one or more immunological active molecules comprises one or more molecule(s) selected from the group consisting of Co-stimulatory molecules such as CD2, CD3, CD4, CD5, CD8, CD9, CD27, CD28, CD30, CD69, CD134 (OX40), CD120, CD137 (4-1BB), CD147, CDw150 (SLAM), CD152 (CTLA-4), CD153 (CD30L), CD40L (CD154), NKG2D, ICOS, PD-1, Fas (CD95), FasL, CD40, CD58, CD70, CD72, B7.1 (CD80), B7.2 (CD86), B7RP-1, B7-H3, PD-L1, PD-L2, CD134L, CD137L, ICOSL.

915. The composition according to item 901, wherein the one or more immunological active molecules comprises one or more molecule(s) selected from the group consisting of NK cell receptors/molecules such as CD16, NKp30, NKp44, NKp46, NKp80, 2B4, KIR3DL1, KIR3DL", KIR3DS1, KIR2DL1, KIRDL2, KIR2DL3, KIR2DL4, KIR2DL5, CD94/NKG2A, CD94/NKG2C, CD94/NKG2E, CD94/NKG2H, NKG2ADNKG2D.

916. The composition according to item 901, wherein the one or more immunological active molecules comprises one or more molecule(s) selected from the group consisting of Adhesion molecules such as ICAM-1, ICAM-2, GlyCAM-1, VCAM, CD34.

917. The composition according to item 901, wherein the one or more immunological active molecules comprises one or more molecule(s) selected from the group consisting of Anti microbial peptides such Defensins and cathelicidin derived peptide LL-37.

918. The composition according to item 901, wherein the one or more immunological active molecules comprises one or more molecule(s) selected from the group consisting of anti-LFA-1, anti-CD44, anti-beta7, anti-selectin L, anti-selectin E, and anti-selectin P, toxic molecules selected from toxins, enzymes, antibodies, radioisotopes, chemiluminescent substances, bioluminescent substances, polymers, metal particles, and haptens, such as cyclophosphamide, methrotrexate, Azathioprine, mizoribine, 15-deoxuspergualin, neomycin, staurosporine, genestein, herbimycin A, Pseudomonas exotoxin A, saporin, Rituxan, Ricin, gemtuzumab ozogamicin, Shiga toxin, vitamin D3, IL-2 toxins, cyclosporin, FK-506, rapamycin, TGF-beta, clotrimazole, nitrendipine, and charybdotoxin, heavy' metals like inorganic and organic mercurials, and FN18-CRM9, radioisotopes such as incorporated isotopes of iodide, cobalt, selenium, tritium, and phosphor, and haptens such as DNP, and digoxiginin, and combinations of any of the foregoing, as well as antibodies (monoclonal, polyclonal, and recombinant) to the foregoing, where relevant.

919. The composition according to item 901, wherein the one or more immunological active molecules comprises one or more molecule(s) selected from the group consisting of antibody derivatives or fragments thereof.

920. The composition according to item 901, wherein the one or more immunological active molecules comprises one or more molecule(s) selected from the group consisting of biologically active molecules derived from viral or bacterial proteins or fragments thereof.

921. The composition according to item 882, wherein the vaccine further comprises one or more biologically active molecules in order to affect the characteristics of the constructs, e. g. with respect to binding properties, effects, antigenecity, specificity, solubility, stability, or detectability.

922. The composition according to item 882, wherein the one or more biologically active molecules further comprises a flexible or rigid, and water soluble, linker that allows for the immobilized biologically active molecules to interact efficiently with surrounding cells and molecules.

923. The composition according to item 882, wherein the one or more biologically active molecules further comprises a cleavable linker allowing for release of the biologically active molecules from the multimerization domain such as a bead.

924. The composition according to item 1, wherein the one or more pharmamers has a molecular weight in the range 50,000 Da to 5,000,000 Da, such as from 50,000 Da to 4,000,000 Da; such as from 50,000 Da to 3,000,000 Da; such as from 50,000 Da to 2,000,000; such as from 50,000 Da and 1,000,000 Da, such as from 50,000 Da to 980,000; for example from 50,000 Da to 960,000; such as from 50,000 Da to 940,000; for example from 50,000 Da to 920,000; such as from 50,000 Da to 900,000; for example from 50,000 Da to 880,000; such as from 50,000 Da to 860,000; for example from 50,000 Da to 840,000; such as from 50,000 Da to 820,000; for example from 50,000 Da to 800,000; such as from 50,000 Da to 780,000; for example from 50,000 Da to 760,000; such as from 50,000 Da to 740,000; for example from 50,000 Da to 720,000; such as from 50,000 Da to 700,000; for example from 50,000 Da to 680,000; such as from 50,000 Da to 660,000; for example from 50,000 Da to 640,000; such as from 50,000 Da to 620,000; for example from 50,000 Da to 600,000; such as from 50,000 Da to 580,000; for example from 50,000 Da to 560,000; such as from 50,000 Da to 540,000; for example from 50,000 Da to 520,000; such as from 50,000 Da to 500,000; for example from 50,000 Da to 480,000; such as from 50,000 Da to 460,000; for example from 50,000 Da to 440,000; such as from 50,000 Da to 420,000; for example from 50,000 Da to 400,000; such as from 50,000 Da to 380,000; for example from 50,000 Da to 360,000; such as from 50,000 Da to 340,000; for example from 50,000 Da to 320,000; such as from 50,000 Da to 300,000; for example from 50,000 Da to 280,000; such as from 50,000 Da to 260,000; for example from 50,000 Da to 240,000; such as from 50,000 Da to 220,000; for example from 50,000 Da to 200,000; such as from 50,000 Da to 180,000; for example from 50,000 Da to 160,000; such as from 50,000 Da to 140,000; for example from 50,000 Da to 120,000; such as from 50,000 Da to 100,000; for example from 50,000 Da to 80,000; such as from 50,000 Da to 60,000; such as from 100,000 Da to 980,000; for example from 100,000 Da to 960,000; such as from 100,000 Da to 940,000; for example from 100,000 Da to 920,000; such as from 100,000 Da to 900,000; for example from 100,000 Da to 880,000; such as from 100,000 Da to 860,000; for example from 100,000 Da to 840,000; such as from 100,000 Da to 820,000; for example from 100,000 Da to 800,000; such as from 100,000 Da to 780,000; for example from 100,000 Da to 760,000; such as from 100,000 Da to 740,000; for example from 100,000 Da to 720,000; such as from 100,000 Da to 700,000; for example from 100,000 Da to 680,000; such as from 100,000 Da to 660,000; for example from 100,000 Da to 640,000; such as from 100,000 Da to 620,000; for example from 100,000 Da to 600,000; such as from 100,000 Da to 580,000; for example from 100,000 Da to 560,000; such as from 100,000 Da to 540,000; for example from 100,000 Da to 520,000; such as from 100,000 Da to 500,000; for example from 100,000 Da to 480,000; such as from 100,000

Da to 460,000; for example from 100,000 Da to 440,000; such as from 100,000 Da to 420,000; for example from 100,000 Da to 400,000; such as from 100,000 Da to 380,000; for example from 100,000 Da to 360,000; such as from 100,000 Da to 340,000; for example from 100,000 Da to 320,000; such as from 100,000 Da to 300,000; for example from 100,000 Da to 280,000; such as from 100,000 Da to 260,000; for example from 100,000 Da to 240,000; such as from 100,000 Da to 220,000; for example from 100,000 Da to 200,000; such as from 100,000 Da to 180,000; for example from 100,000 Da to 160,000; such as from 100,000 Da to 140,000; for example from 100,000 Da to 120,000; such as from 150,000 Da to 980,000; for example from 150,000 Da to 960,000; such as from 150,000 Da to 940,000; for example from 150,000 Da to 920,000; such as from 150,000 Da to 900,000; for example from 150,000 Da to 880,000; such as from 150,000 Da to 860,000; for example from 150,000 Da to 840,000; such as from 150,000 Da to 820,000; for example from 150,000 Da to 800,000; such as from 150,000 Da to 780,000; for example from 150,000 Da to 760,000; such as from 150,000 Da to 740,000; for example from 150,000 Da to 720,000; such as from 150,000 Da to 700,000; for example from 150,000 Da to 680,000; such as from 150,000 Da to 660,000; for example from 150,000 Da to 640,000; such as from 150,000 Da to 620,000; for example from 150,000 Da to 600,000; such as from 150,000 Da to 580,000; for example from 150,000 Da to 560,000; such as from 150,000 Da to 540,000; for example from 150,000 Da to 520,000; such as from 150,000 Da to 500,000; for example from 150,000 Da to 480,000; such as from 150,000 Da to 460,000; for example from 150,000 Da to 440,000; such as from 150,000 Da to 420,000; for example from 150,000 Da to 400,000; such as from 150,000 Da to 380,000; for example from 150,000 Da to 360,000; such as from 150,000 Da to 340,000; for example from 150,000 Da to 320,000; such as from 150,000 Da to 300,000; for example from 150,000 Da to 280,000; such as from 150,000 Da to 260,000; for example from 150,000 Da to 240,000; such as from 150,000 Da to 220,000; for example from 150,000 Da to 200,000; such as from 150,000 Da to 180,000; for example from 150,000 Da to 160,000.

925. The composition according to item 1, wherein the one or more pharmamers has a molecular weight in the range 50,000 Da to 5,000,000 Da, such as from 50,000 Da to 100,000 Da, for example from 100,000 Da to 200,000 Da, such as from 200,000 Da to 300,000 Da, for example from 300,000 Da to 400,000 Da, such as from 400,000 Da to 500,000 Da, for example from 500,000 Da to 600,000 Da, such as from 600,000 Da to 700,000 Da, for example from 700,000 Da to 800,000 Da, such as from 800,000 Da to 900,000 Da, for example from 900,000 Da to 1,000,000 Da, such as from 1,000,000 Da to 1,200,000 Da, for example from 1,200,000 Da to 1,400,000 Da, such as from 1,400,000 Da to 1,600,000 Da, for example from 1,600,000 Da to 1,800,000 Da, such as from 1,800,000 Da to 2,000,000 Da, for example from 2,000,000 Da to 2,200,000 Da, such as from 2,200,000 Da to 2,400,000 Da, for example from 2,400,000 Da to 2,600,000 Da, such as from 2,600,000 Da to 2,800,000 Da, for example from 2,800,000 Da to 3,000,000 Da, such as from 3,000,000 Da to 3,200,000 Da, for example from 3,200,000 Da to 3,400,000 Da, such as from 3,400,000 Da to 3,600,000 Da, for example from 3,600,000 Da to 3,800,000 Da, such as from 3,800,000 Da to 4,000,000 Da, for example from 4,000,000 Da to 4,200,000 Da, such as from 4,200,000 Da to 4,400,000 Da, for example from 4,400,000 Da to 4,600,000 Da, such as from 4,600,000 Da to 4,800,000 Da, for example from 4,800,000 Da to 5,000,000 Da.

926. The composition according to item 882, wherein the one or more multimerization domains(s) comprises one or more soluble multimerization domain(s).

927. The composition according to item 882, wherein the one or more multimerization domains(s) comprises one or more insoluble multimerization domain(s).

928. The composition according to item 882, wherein the one or more multimerization domains(s) comprises one or more multimerization domains selected from the group consisting of polysaccharides, dextrans, carboxy methyl dextran, dextran polyaldehyde, carboxymethyl dextran lactone, and cyclodextrins, pullulans, schizophyllan, scleroglucan, xanthan, gellan, O-ethylamino guaran, chitins and chitosans indlucing 6-O-carboxymethyl chitin and N-carboxymethyl chitosan, derivatised cellolosics including carboxymethyl cellulose, carboxymethyl hydroxyethyl cellulose, hydroxy-ethyl cellulose, 6-amino-6-deoxy cellulose and O-ethyl-amine cellulose, hydroxylated starch, hydroxypropyl starch, hydroxyethyl starch, carrageenans, alginates, and agarose, synthetic polysaccharides including ficoll and carboxy-methylated ficoll, vinyl polymers including poly (acrylic-acid), poly (acryl amides), poly (acrylic esters), poly (2-hydroxy ethyl methacrylate), poly (methyl methacrylate), poly (maleic acid), poly (maleic anhydride), poly (acrylamide), poly (ethyl-co-vinyl acetate), poly (methacrylic acid), poly (vinyl-alcohol), poly (vinyl alcohol-co-vinyl chloroacetate), aminated poly (vinyl alcohol), and co block polymers thereof, poly ethylene glycol (PEG) or polypropylene glycol or poly (ethylene oxide-co-propylene oxides) comprising polymer backbones including linear, comb-shaped or Star-Burst dendrimers, poly amino acids including polylysines, polyglutamic acid, polyurethanes, poly (ethylene imines), pluriol, proteins including peptides, polypeptides, antigen-binding peptides, albumins, immunoglobulins, coiled-coil helixes e.g. Fos-Jun or Fos-Jun like or coiled-coiled dimers/trimers/tetramers/pentamers, Streptavidin, Avidin, Streptactin, T-cell receptors orther protein receptors and virus-like proteins (VLP), and polynucleotides, DNA, RNA, PNA, LNA, oligonucleotides and oligonucleotide dendrimer constructs and small organic molecules including but not limited to steroids, peptides, linear or cyclic structures, aromatic structures, aliphatic structures.

929. The composition according to item 882, wherein the one or more multimerization domains(s) comprises cells e.g. dendritic cells, antigen presenting cell, B-cell, T-cell Macrophages, Kupfer cells, Langerhans cells, transfected cells expressing biologically active proteins, including hybridoma cells, yeast-cells, insect-cells, CHO cells, any cell biologically active molecules, cell-like structures e.g. micelles, liposomes, and phages e.g. filamenteous phages and viral or viral-like particles.

930. The composition according to item 882, wherein the one or more multimerization domains(s) comprises one or more solid supports including but not limited to beads, particulate matters and other surfaces.

931. The composition according to item 882, wherein the one or more multimerization domains(s) comprises one or more self-assembling multimeric structures.

932. The composition according to item 882, wherein the one or more multimerization domains(s) comprises mixed forms of multimerization domains such as e.g. dextran coupled with Streptavidin.

933. The composition according to item 882, wherein the one or more multimerization domains(s) comprises one or more multimerisation domains made of Streptavidin or Avidin whereto biotin, biotin-like peptides or other biotin-like molecules can bind.

934. The composition according to item 882, wherein the one or more multimerization domains(s) comprises dextran whereto biologically active molecules are attached directly through a linker.

935. The composition according to item 882, wherein the one or more multimerization domains(s) comprises divinylsulfone activated dextran whereto biologically active molecules are coupled directly e.g. through —SH group(s) or amine(s) in the biologically active molecules, dextran coupled with SA whereto biologically active molecules are attached through a biotin on the biologically active molecule, dextran with biologically active molecules are attached through a coiled-coil structure where on α-helix of a coiled-coil dimer is coupled to dextran and the other α-helix is coupled to the biologically active molecule e.g. as a fusion protein.

936. The composition according to item 882, wherein the one or more multimerization domains(s) comprises beads or bead-like structures having an excluded volume (e.g. polysaccharide beads, polystyrene beads, magnetic polystyrene beads, polycarbamate beads, or any other kind of beads that can be dissolved or suspended in aqueous buffer) that carry electrophilic groups (e.g. divinyl sulfone activated polysaccharide, polystyrene beads that have been functionalized with tosyl-activated esters, magnetic polystyrene beads functionalized with tosyl-activated esters), and where biologically active molecules have been covalently immobilized to these by reaction of nucleophiles comprised within the biologically active molecule with the electrophiles of the beads.

937. The composition according to item 882, wherein the one or more multimerization domains(s) comprises one or more beads covalently or non-covalently coated with pharmamers or single biologically active molecules, through non-cleavable or cleavable linkers.

938. The composition according to item 882, wherein the one or more multimerization domains(s) comprises one or more beads coated with streptavidin monomers, which in turn are associated with biotinylated pharmamers.

939. The composition according to item 882, wherein the one or more multimerization domains(s) comprises one or more beads coated with streptavidin tetramers, each of which are associated with 0, 1, 2, 3, or 4 biotinylated biologically active molecules.

940. The composition according to item 882, wherein the one or more multimerization domains(s) comprises one or more beads coated with biologically active molecules where e.g. the reactive groups of the biologically active molecules (e.g. the divinyl sulfone-activated dextran backbone) has reacted with nucleophilic groups on the bead, to form a covalent linkage between the dextran of the dextramer and the beads.

941. The composition according to item 882, wherein the one or more multimerization domains(s) comprises one or more self-assembling multimeric structures such as trimeric, tetrameric, pentameric, hexameric or heptameric coiled-coil structures holding together 3, 4, 5, 6 or 7 biologically active molecules.

942. The composition according to item 882, wherein the one or more multimerization domains(s) comprises several multimerization domains (e.g. streptavidin tetramers bound to biotinylated biologically active molecules) linked to another multimerization domain (e.g. the bead).

943. The composition according to item 882, wherein the one or more multimerization domains(s) comprises any support capable of binding the biologically active molecules.

944. The composition according to item 882, wherein the one or more multimerization domains(s) comprises glass, polystyrene, polypropylene, polyethylene, dextran, nylon, amylases, natural and modified celluloses, polyacrylamides, gabbros, and magnetite.

945. The composition according to item 882, wherein the one or more multimerization domains(s) comprises one or more spherical supports such as one or more bead.

946. The composition according to item 882, wherein the one or more multimerization domains(s) comprises one or more cylindrical supports such as the inside surface of a test tube, or the external surface of a rod.

947. The composition according to item 882, wherein the one or more multimerization domains(s) comprises one or more flat supports such as a sheet, test strip, a membrane, or a plastic surface.

948. The composition according to item 882, wherein the one or more multimerization domains(s) comprises one or more polymers, oligomers and/or non-repeating moieties.

949. The composition according to item 882, wherein the one or more multimerization domains(s) comprises one or more polymers or oligomer moieties e.g. comprising repeat units consisting of a repeat moiety selected from alkyl (e.g., —$CH_2$—), substituted alkyl (e.g., —CHR—), alkenyl, substituted alkenyl, alkynyl, substituted alkynyl, phenyl, aryl, heterocyclic, amine, ether, sulfide, disulfide, hydrazine, and any of the foregoing substituted with oxygen, sulfur, sulfonyl, phosphonyl, hydroxyl, alkoxyl, amine, thiol, ether, carbonyl, carboxyl, ester, amide, alkyl, alkenyl, alkynyl, aryl, heterocyclic, as well as moieties comprising combinations thereof.

950. The composition according to item 882, wherein the one or more multimerization domains(s) comprises one or more non-repeating multifunctional bridge moieties selected from alkyl, phenyl, aryl, alkenyl, alkynyl, heterocyclic, amine, ether, sulfide, disulfide, hydrazine, and any of the foregoing substituted with oxygen, sulfur, sulfonyl, phosphonyl, hydroxyl, alkoxyl, amine, thiol, ether, carbonyl, carboxyl, ester, amide, alkyl, alkenyl, alkynyl, aryl, heterocyclic, and moieties comprising combinations thereof.

951. The composition according to item 882, wherein the one or more multimerization domains(s) comprises one or more oligomers (or oligomer moieties) or polymers (or polymer moieties), that are soluble or insoluble.

952. The composition according to item 882, wherein the one or more multimerization domains(s) comprises one or more oligomers (or oligomer moieties) or polymers (or polymer moieties) comprising one or more cross-linked oligomer (or oligomer moieties) or cross-linked polymers (or polymer moieties).

953. The composition according to item 882, wherein the one or more multimerization domains(s) comprises one or more oligomers (or oligomer moieties) or polymers (or polymer moieties) comprising one or more homopolymers and/or one or more copolymers (including polymers having two monomer-repeat-units, terpolymers and higher-order polymers), including for example random copolymer moieties and block copolymer moieties.

954. The composition according to item 882, wherein the one or more multimerization domains(s) comprises one or more oligomers (or oligomer moieties) or polymers (or polymer moieties) comprising one or more ionic monomer moieties such as one or more anionic monomer moieties.

955. The composition according to item 882, wherein the one or more multimerization domains(s) comprises one or more oligomers (or oligomer moieties) or polymers (or polymer moieties) comprising one or more hydrophobic and/or hydrophilic monomer moieties.

956. The composition according to item 882, wherein the one or more multimerization domains(s) comprises from 1 to 100 coupling sites for biologically active molecules, such as from 1 to 5 coupling sites, for example from 5 to 10 coupling sites, such as from 10 to 15 coupling sites, for example from 15 to 20 coupling sites, such as from 20 to 25 coupling sites, for example from 25 to 30 coupling sites, such as from 30 to 35 coupling sites, for example from 35 to 40 coupling sites, such as from 40 to 45 coupling sites, for example from 45 to 50 coupling sites, such as from 50 to 55 coupling sites, for example from 55 to 60 coupling sites, such as from 60 to 65 coupling sites, for example from 65 to 70 coupling sites, such as from 70 to 75 coupling sites, for example from 75 to 80 coupling sites, such as from 80 to 85 coupling sites, for example from 85 to 90 coupling sites, such as from 90 to 95 coupling sites, for example from 95 to 100 coupling sites.

957. The composition according to item 882, wherein the one or more multimerization domains(s) comprises one or more polymer moieties that are soluble or insoluble, exist as dispersed micelles or particles, such as colloidal particles or (insoluble) macroscopic beads.

958. The composition according to item 882, wherein the one or more multimerization domains(s) comprises one or more polymer moieties that are hydrophobic, hydrophilic, amphiphilic, uncharged or non-ionic, negatively or positively charged, or a combination thereof, and can be organic or inorganic.

959. The composition according to item 882, wherein the one or more multimerization domains(s) comprises one or more inorganic polymer moieties such as silica (e.g., multi-layered silica), diatomaceous earth, zeolite, calcium carbonate, talc, and the like.

960. The composition according to item 882, wherein the one or more multimerization domains(s) comprises one or more water-soluble polymers including polyethylene glycol (PEG), monomethoxy-PEG, mono-($C_1$-$C_{10}$)alkoxy-PEG, aryloxy-PEG, poly-(N-vinyl pyrrolidone)PEG, tresyl monomethoxy PEG, PEG propionaldehyde, bis-succinimidyl carbonate PEG, propylene glycol homopolymers, a polypropylene oxide/ethylene oxide co-polymer, polyoxyethylated polyols (e.g., glycerol), polyvinyl alcohol, dextran, cellulose, or other carbohydrate-based polymers.

961. The composition according to item 882, wherein the one or more multimerization domains(s) comprises one or more polysaccharides such as materials from vegetal or animal origin, including cellulose materials, hemicellulose, alkyl cellulose, hydroxyalkyl cellulose, carboxymethylcellulose, sulfoethylcellulose, starch, xylan, amylopectine, chondroitin, hyarulonate, heparin, guar, xanthan, mannan, galactomannan, chitin, and/or chitosan.

962. The composition according to item 882, wherein the one or more multimerization domains(s) comprises one or more multimerization domain selected from the group consisting of agarose, sepharose, resin beads, glass beads, pore-glass beads, glass particles coated with a hydrophobic polymer, chitosan-coated beads, SH beads, latex beads, spherical latex beads, allele-type beads, SPA bead, PEG-based resins, PEG-coated bead, PEG-encapsulated bead, polystyrene beads, magnetic polystyrene beads, glutathione agarose beads, magnetic bead, paramagnetic beads, protein A and/or protein G sepharose beads, activated carboxylic acid bead, macroscopic beads, microscopic beads, insoluble resin beads, silica-based resins, cellulosic resins, cross-linked agarose beads, polystyrene beads, cross-linked polyacrylamide resins, beads with iron cores, metal beads, dynabeads, Polymethylmethacrylate beads activated with NHS, streptavidin-agarose beads, polypropylene, polyethylene, dextran, nylon, amylases, natural and modified celluloses, nitrocellulose, polyacrylamides, gabbros, magnetite, polymers, oligomers, non-repeating moieties, polyethylene glycol (PEG), monomethoxy-PEG, mono-($C_1$-$C_{10}$)alkoxy-PEG, aryloxy-PEG, poly-(N-vinyl pyrrolidone)PEG, tresyl monomethoxy PEG, PEG propionaldehyde, bis-succinimidyl carbonate PEG, polystyrene bead crosslinked with divinylbenzene, propylene glycol homopolymers, a polypropylene oxide/ethylene oxide co-polymer, polyoxyethylated polyols (e.g., glycerol), polyvinyl alcohol, dextran, aminodextran, carbohydrate-based polymers, cross-linked dextran beads, polysaccharide beads, polycarbamate beads, polyvinylcarbamate, divinyl sulfone activated polysaccharide, polystyrene beads that have been functionalized with tosyl-activated esters, magnetic polystyrene beads functionalized with tosyl-activated esters, streptavidin beads, streptavidin-monomer coated beads, streptavidin-tetramer coated beads, Streptavidin Coated Compel Magnetic beads, avidin coated beads, dextramer coated beads, divinyl sulfone-activated dextran, Carboxylate-modified bead, amine-modified beads, antibody coated beads, cellulose beads, grafted co-poly beads, poly-acrylamide beads, dimethylacrylamide beads optionally crosslinked with N—N'-bis-acryloylethylenediamine, hollow fiber membranes, fluorescent beads, collagen-agarose beads, gelatin beads, collagen-gelatin beads, collagen-fibronectin-gelatin beads, collagen beads, chitosan beads, collagen-chitosan beads, protein-based beads, hydrogel beads, hemicellulose, alkyl cellulose, hydroxyalkyl cellulose, carboxymethylcellulose, sulfoethylcellulose, starch, xylan, amylopectine, chondroitin, hyarulonate, heparin, guar, xanthan, mannan, galactomannan, chitin and chitosan.

963. The composition according to item 882, wherein the one or more multimerization domains(s) comprises one or more multimerization domain(s) with a molecular weight of less than 1,000 Da (e.g. small molecule scaffold).

964. The composition according to item 882, wherein the one or more multimerization domains(s) comprises one or more multimerization domain(s) with a molecular weight of between 1,000 Da and 10,000 Da (e.g. small molecule scaffold, small peptides, small polymers) such as from 1,000 Da to 2,000 Da, for example from 2,000 Da to 3,000 Da, such as from 3,000 Da to 4,000 Da, for example from 4,000 Da to 5,000 Da, such as from 5,000 Da to 6,000 Da, for example from 6,000 Da to 7,000 Da, such as from 7,000 Da to 8,000 Da, for example from 8,000 Da to 9,000 Da, such as from 9,000 Da to 10,000 Da.

965. The composition according to item 882, wherein the one or more multimerization domains(s) comprises one or more multimerization domain(s) with a molecular weight of between 10,000 Da and 100,000 Da (e.g. Small molecule scaffold, polymers e.g. dextran, streptavidin, IgG, pentamer structure) such as from 10,000 Da to 20,000 Da, for example from 20,000 Da to 30,000 Da, such as from 30,000 Da to 40,000 Da, for example from 40,000 Da to 50,000 Da, such as from 50,000 Da to 60,000 Da, for example from 60,000 Da to 70,000 Da, such as from 70,000 Da to 80,000 Da, for example from 80,000 Da to 90,000 Da, such as from 90,000 Da to 100,000 Da.

966. The composition according to item 882, wherein the one or more multimerization domains(s) comprises one or more multimerization domain(s) with a molecular weight of between 100,000 Da and 1,000,000 Da (e.g. Small molecule scaffold, polymers e.g. dextran, streptavidin, IgG, pentamer structure) such as from 100,000 Da to 200,000 Da, for example from 200,000 Da to 300,000 Da, such as from 300,000 Da to 400,000 Da, for example from 400,000 Da to 500,000 Da, such as from 500,000 Da to 600,000 Da, for example from 600,000 Da to 700,000 Da, such as from 700,000 Da to 800,000 Da, for example from 800,000 Da to 900,000 Da, such as from 900,000 Da to 1,000,000 Da.

967. The composition according to item 882, wherein the one or more multimerization domains(s) comprises one or more multimerization domain(s) with a molecular weight of more than 1,000,000 Da (e.g. Small molecule scaffold, polymers e.g. dextran, streptavidin, IgG, pentamer structure, cells, liposomes, artificial lipid bi layers, polystyrene beads and other beads) such as more than 2,000,000 Da, for example more than 3,000,000 Da, such as more than 5,000,000, for example more than 10,000,000 Da.

968. The composition according to item 882, wherein the one or more biologically active molecules and the one or more multimerization domains(s) are coupled by chemical reactions between reactive groups of the multimerization domain and reactive groups on the biologically active molecule.

969. The composition according to item 882, wherein the one or more biologically active molecules and the one or more multimerization domains(s) are coupled by non-covalent interaction between a part of the biologically active molecule (e.g. a biotinylated peptide component) and the multimerization domain (e.g. four binding sites for biotin on the strepavidin tetrameric protein).

970. The composition according to item 1, wherein the one or more pharmamers comprises non-covalent association of amino acid helices fused to one component of a biologically active molecule, to form e.g. a pentameric pharmamer, held together by e.g. five helices in a coiled-coil structure making up the multimerization domain.

971. The composition according to item 882, wherein the one or more biologically active molecules and the one or more multimerization domains(s) are coupled by one or more chemical reactions 972. The composition according to item 971, wherein the one or more chemical reactions comprises nucleophilic substitution by activation of electrophiles (e.g. acylation such as amide formation, pyrazolone formation, isoxazolone formation; alkylation; vinylation; disulfide formation).

973. The composition according to item 971, wherein the one or more chemical reactions comprises addition to carbon-hetero multiple bonds (e.g. alkene formation by reaction of phosphonates with aldehydes or ketones; arylation; alkylation of arenes/hetarenes by reaction with alkyl boronates or enolethers).

974. The composition according to item 971, wherein the one or more chemical reactions comprises nucleophilic substitution using activation of nucleophiles (e.g. condensations; alkylation of aliphatic halides or tosylates with enolethers or enamines).

975. The composition according to item 971, wherein the one or more chemical reactions comprises cycloadditions.

976. The composition according to item 971, wherein the one or more biologically active molecules and the one or more multimerization domains(s) are coupled one or more non-covalent interaction(s).

977. The composition according to item 976, wherein the one or more non-covalent interaction(s) comprises streptavidin/biotin.

978. The composition according to item 976, wherein the one or more non-covalent interaction(s) comprises avidin/biotin.

979. The composition according to item 976, wherein the one or more non-covalent interaction(s) comprises antibody/antigen.

980. The composition according to item 976, wherein the one or more non-covalent interaction(s) comprises DNA/DNA.

981. The composition according to item 976, wherein the one or more non-covalent interaction(s) comprises DNA/PNA.

982. The composition according to item 976, wherein the one or more non-covalent interaction(s) comprises DNA/RNA.

983. The composition according to item 976, wherein the one or more non-covalent interaction(s) comprises PNA/PNA.

984. The composition according to item 976, wherein the one or more non-covalent interaction(s) comprises LNA/DNA.

985. The composition according to item 976, wherein the one or more non-covalent interaction(s) comprises leucine zipper e.g. Fos/Jun.

986. The composition according to item 976, wherein the one or more non-covalent interaction(s) comprises IgG dimeric protein.

987. The composition according to item 976, wherein the one or more non-covalent interaction(s) comprises IgM multivalent protein.

988. The composition according to item 976, wherein the one or more non-covalent interaction(s) comprises acid/base coiled-coil helices.

989. The composition according to item 976, wherein the one or more non-covalent interaction(s) comprises chelate/metal ion-bound chelate.

990. The composition according to item 976, wherein the one or more non-covalent interaction(s) comprises streptavidin (SA) and avidin and derivatives thereof.

991. The composition according to item 976, wherein the one or more non-covalent interaction(s) comprises biotin.

992. The composition according to item 976, wherein the one or more non-covalent interaction(s) comprises immunoglobulins.

993. The composition according to item 976, wherein the one or more non-covalent interaction(s) comprises antibodies (monoclonal, polyclonal, and recombinant).

994. The composition according to item 976, wherein the one or more non-covalent interaction(s) comprises antibody fragments and derivatives thereof.

995. The composition according to item 976, wherein the one or more non-covalent interaction(s) comprises leucine zipper domain of AP-1 (jun and fos).

996. The composition according to item 976, wherein the one or more non-covalent interaction(s) comprises hexa-his (metal chelate moiety).

997. The composition according to item 976, wherein the one or more non-covalent interaction(s) comprises hexa-hat GST (glutathione S-transferase) glutathione affinity.

998. The composition according to item 976, wherein the one or more non-covalent interaction(s) comprises Calmodulin-binding peptide (CBP).

999. The composition according to item 976, wherein the one or more non-covalent interaction(s) comprises Strep-tag.

1000. The composition according to item 976, wherein the one or more non-covalent interaction(s) comprises Cellulose Binding Domain.
1001. The composition according to item 976, wherein the one or more non-covalent interaction(s) comprises one or more of the molecules selected from the group consisting of Maltose Binding Protein, S-Peptide Tag, Chitin Binding Tag, Immuno-reactive Epitopes, Epitope Tags, E2Tag, HA Epitope Tag, Myc Epitope, FLAG Epitope, AU1 and AU5 Epitopes, Glu-Glu Epitope, KT3 Epitope, IRS Epitope, Btag Epitope, Protein Kinase-C Epitope, VSV Epitope, lectins that mediate binding to a diversity of compounds, including carbohydrates, lipids and proteins, e.g. Con A (*Canavalia ensiformis*) or WGA (wheat germ agglutinin) and tetranectin or Protein A or G (antibody affinity).
1002. The composition according to item 1, wherein the composition comprises one or more living virulent organism(s).
1003. The composition according to item 1002, wherein the one or more living virulent organism(s) comprises one or more fully virulent organism(s).
1004. The composition according to item 1002, wherein the one or more living virulent organism(s) comprises one or more partly virulent organism(s).
1005. The composition according to item 1002, wherein the one or more living virulent organism(s) comprises one or more partly virulent organism(s) and one or more fully virulent organism(s).
1006. The composition according to item 1004, wherein the one or more partly virulent organism(s) comprises one or more live attenuated microorganism(s).
1007. The composition according to item 1006, wherein the one or more live attenuated microorganism(s) are modified by physical means.
1008. The composition according to item 1007, wherein the physical means comprises heat.
1009. The composition according to item 1006, wherein the one or more live attenuated microorganism(s) are modified by chemical means.
1010. The composition according to item 1009, wherein the chemical means comprises one or more chemical(s).
1011. The composition according to item 1006, wherein the one or more live attenuated microorganism(s) are modified by genetic manipulation.
1012. The composition according to item 1011, wherein the genetic manipulation comprises generation of a recombinant bacteria missing virulence factors.
1013. The composition according to item 1006, wherein the one or more live attenuated microorganism(s) are cultured under conditions that disable their virulent properties.
1014. The composition according to item 1, wherein the composition comprises one or more killed organism(s).
1015. The composition according to item 1014, wherein the one or more killed organism(s) comprises one or more physically killed organism(s).
1016. The composition according to item 1015, wherein the one or more physically killed organism(s) is killed by heat.
1017. The composition according to item 1015, wherein the one or more physically killed organism(s) is killed by irradiation.
1018. The composition according to item 1014, wherein the one or more killed organism(s) comprises one or more chemically killed organism(s).
1019. The composition according to item 1018, wherein the one or more chemically killed organism(s) are killed by phenol.
1020. The composition according to item 1018, wherein the one or more chemically killed organism(s) are killed by formaldehyde.
1021. The composition according to item 1, wherein the composition comprises one or more fragments of one or more microorganism(s).
1022. The composition according to item 1021, wherein the one or more fragments of one or more microorganism(s) are isolated directly from the one or more microorganism(s).
1023. The composition according to item 1, wherein the composition comprises early HBV vaccine.
1024. The composition according to item 1021, wherein the one or more fragments of one or more microorganism(s) are produced by recombinant DNA technology.
1025. The composition according to item 1, wherein the composition comprises HPV vaccine.
1026. The composition according to item 1, wherein the composition comprises one or more macromolecule(s).
1027. The composition according to item 1026, wherein the one or more macromolecule(s) comprises one or more naturally occurring protein(s).
1028. The composition according to item 1027, wherein the one or more naturally occurring protein(s) are isolated and used directly.
1029. The composition according to item 1027, wherein the one or more naturally occurring protein(s) that are isolated and used directly comprises one or more cytokine(s).
1030. The composition according to item 1027, wherein the one or more naturally occurring protein(s) that are isolated and used directly comprises one or more interleukine(s).
1031. The composition according to item 1027, wherein the one or more naturally occurring protein(s) that are isolated and used directly comprises one or more interferone(s).
1032. The composition according to item 1027, wherein the one or more naturally occurring protein(s) that are isolated and used directly comprises one or more antibodies(s).
1033. The composition according to item 1032, wherein the one or more antibodies(s) comprises one or more monoclonal antibodies.
1034. The composition according to item 1032, wherein the one or more antibodies(s) comprises one or more polyclonal antibodies.
1035. The composition according to item 1027, wherein the one or more naturally occurring protein(s) are isolated and modified.
1036. The composition according to item 1035, wherein the one or more naturally occurring protein(s) that are isolated and modified comprises one or more modified toxin(s).
1037. The composition according to item 1036, wherein the one or more modified toxin(s) are chemically modified.
1038. The composition according to item 1036, wherein the one or more modified toxin(s) are physically modified.
1039. The composition according to item 1035, wherein the one or more naturally occurring protein(s) that are isolated and modified comprises one or more modified antibodies.
1040. The composition according to item 1039, wherein the one or more modified antibodies are chemically modified.
1041. The composition according to item 1039, wherein the one or more modified antibodies are digested into one or more fragment(s).
1042. The composition according to item 1041, wherein the one or more fragment(s) comprises one or more Fab fragment(s).
1043. The composition according to item 1026, wherein the one or more macromolecule(s) comprises one or more recombinant protein(s).

1044. The composition according to item 1043, wherein the one or more recombinant protein(s) comprises one or more antibodies.

1045. The composition according to item 1044, wherein the one or more antibodies comprises one or more full length antibodies.

1046. The composition according to item 1044, wherein the one or more antibodies comprises one or more Fab fragments.

1047. The composition according to item 1044, wherein the one or more antibodies comprises one or more scFv fragments.

1048. The composition according to item 1044, wherein the one or more antibodies comprises one or more antibody-like scaffolds.

1049. The composition according to item 1044 to 1048, wherein the one or more antibodies are natural in sequence.

1050. The composition according to item 1044 to 1048, wherein the one or more antibodies are artificial in sequence.

1051. The composition according to item 1050, wherein the one or more antibodies that are artificial in sequence have one or more amino acid substitutions in the binding site.

1052. The composition according to item 1043, wherein the one or more recombinant protein(s) comprises one or more MHC molecule(s).

1053. The composition according to item 1052, wherein the one or more MHC molecule(s) are one or more MHC I molecules.

1054. The composition according to item 1053, wherein the one or more MHC I molecules consists of full length and/or truncated heavy chain, full length and/or truncated beta2m and peptide.

1055. The composition according to item 1053, wherein the one or more MHC I molecules consists of full length and/or truncated heavy chain and full length and/or truncated beta2m.

1056. The composition according to item 1053, wherein the one or more MHC I molecules consists of full length and/or truncated heavy chain and peptide.

1057. The composition according to item 1053, wherein the one or more MHC I molecules consists of full length and/or truncated heavy chain.

1058. The composition according to item 1052, wherein the one or more MHC molecule(s) are one or more MHC II molecules.

1059. The composition according to item 1058, wherein the one or more MHC II molecules consists of full length and/or truncated alpha chain and full length and/or truncated beta chain and peptide.

1060. The composition according to item 1058, wherein the one or more MHC II molecules consists of full length and/or truncated alpha chain and full length and/or truncated beta chain.

1061. The composition according to item 1043, wherein the one or more recombinant protein(s) comprises one or more cytokine(s).

1062. The composition according to item 1061, wherein the one or more cytokine(s) are full length.

1063. The composition according to item 1061, wherein the one or more cytokine(s) are truncated.

1064. The composition according to item 1043, wherein the one or more recombinant protein(s) comprises one or more interleukine(s).

1065. The composition according to item 1064, wherein the one or more interleukine(s) are full length.

1066. The composition according to item 1064, wherein the one or more interleukine(s) are truncated.

1067. The composition according to item 1064, wherein the one or more recombinant protein(s) comprises one or more interferrone(s).

1068. The composition according to item 1067, wherein the one or more interferrone(s) are full length.

1069. The composition according to item 1067, wherein the one or more interferrone(s) are truncated.

1070. The composition according to item 1026, wherein the one or more macromolecule(s) comprises one or more nucleic acid(s).

1071. The composition according to item 1070, wherein the one or more nucleic acid(s) comprises DNA.

1072. The composition according to item 1071, wherein the DNA encodes one or more protein(s).

1073. The composition according to item 1071, wherein the DNA does not encode one or more protein(s).

1074. The composition according to item 1070, wherein the one or more nucleic acid(s) comprises RNA.

1075. The composition according to item 1074, wherein the RNA comprises one or more ribozyme(s).

1076. The composition according to item 1074, wherein the RNA comprises antisense.

1077. The composition according to item 1074, wherein the RNA comprises silencing RNA.

1078. The composition according to item 1070, wherein the one or more nucleic acid(s) comprises LNA.

1079. The composition according to item 1070, wherein the one or more nucleic acid(s) comprises PNA.

1080. The composition according to item 1026, wherein the one or more macromolecule(s) comprises one or more carbohydrate(s).

1081. The composition according to item 1080, wherein the one or more carbohydrate(s) comprises one or more pure carbohydrates.

1082. The composition according to item 1081, wherein the one or more pure carbohydrates comprises one or more monosaccharides.

1083. The composition according to item 1082, wherein the one or more monosaccharides are modified.

1084. The composition according to item 1081, wherein the one or more pure carbohydrates comprises one or more disaccharides.

1085. The composition according to item 1084, wherein the one or more disaccharides are modified.

1086. The composition according to item 1081, wherein the one or more pure carbohydrates comprises one or more polysaccharides.

1087. The composition according to item 1086, wherein the one or more polysaccharides are modified.

1088. The composition according to item 1080, wherein the one or more carbohydrate(s) comprises one or more glycoprotein(s).

1089. The composition according to item 1080, wherein the one or more carbohydrate(s) comprises one or more glycolipid(s).

1090. The composition according to item 1026, wherein the one or more macromolecule(s) are not part of a complex.

1091. The composition according to item 1026, wherein the one or more macromolecule(s) are part of one or more complex(es).

1092. The composition according to item 1091, wherein the one or more complex(es) comprises one or more polymer backbone(s).

1093. The composition according to item 1091, wherein the one or more complex(es) is attached to one or more solid support(s).

1094. The composition according to item 1091, wherein the complex is attached to one or more bead(s).
1095. The composition according to item 1, wherein the composition is a cell-based vaccine.
1096. The composition according to item 1095, wherein the cell based vaccine comprises one or more naturally occurring cell(s).
1097. The composition according to item 1096, wherein the one or more naturally occurring cell(s) are isolated and amplified (by proliferation).
1098. The composition according to item 1096, wherein the one or more naturally occurring cell(s) are isolated and modified.
1099. The composition according to item 1098, wherein the one or more naturally occurring cell(s) that are isolated are modified to display one or more specific MHC complex(es).
1100. The composition according to item 1099, wherein the one or more naturally occurring cell(s) that are isolated and modified to display one or more specific MHC complex(es) are incubated with one or more peptide(s).
1101. The composition according to item 1099, wherein the one or more naturally occurring cell(s) that are isolated and modified to display one or more specific MHC complex(es) are fused to one or more other cells.
1102. The composition according to item 1101, wherein the one or more other cells comprise one or more hybridoma cell(s).
1103. The composition according to item 1099, wherein the one or more naturally occurring cell(s) that are isolated and modified to display one or more specific MHC complex(es) are obtained by one or more transfection(s).
1104. The composition according to item 1103, wherein the one or more transfection(s) comprises supercoiled plasmid DNA.
1105. The composition according to item 1103, wherein the one or more transfection(s) comprises siRNA.
1106. The composition according to item 1103, wherein the one or more transfection(s) comprises protein.
1107. The composition according to item 1099, wherein the one or more naturally occurring cell(s) that are isolated and modified by one or more chemical modification step(s).
1108. The composition according to item 1095, wherein the one or more cell based vaccine(s) comprises one or more non-naturally occurring cell(s).
1109. The composition according to item 1108, wherein the one or more cell based vaccine(s) comprises one or more non-naturally occurring cell(s) that are chemically modified.
1110. The composition according to item 1108, wherein the one or more cell based vaccine(s) comprises one or more non-naturally occurring cell(s) that are genetically modified.
1111. The composition according to item 1, wherein the composition is a liposome/micelle-based vaccine.
1112. The composition according to item 1, wherein the composition is a nanocluster-based vaccine.
1113. The composition according to item 1, wherein the composition comprises one or more vaccine adjuvant(s).
1114. The composition according to item 1113, wherein the one or more vaccine adjuvant(s) increases or otherwise modifies the immune response to said vaccine.
1115. The composition according to item 1113, wherein the one or more vaccine adjuvant(s) elicit an earlier and/or more potent immune response to said vaccine.
1116. The composition according to item 1113, wherein the one or more vaccine adjuvant(s) elicit a prolonged and/or more potent immune response to said vaccine.
1117. The composition according to item 1113, wherein the one or more vaccine adjuvant(s) results in increased humoral immunity to said vaccine.
1118. The composition according to item 1113, wherein the one or more vaccine adjuvant(s) results in induction of the complement pathway.
1119. The composition according to item 1113, wherein the one or more vaccine adjuvant(s) results in increased cell mediated immunity to said vaccine.
1120. The composition according to item 1113, wherein the one or more vaccine adjuvant(s) comprises one or more antigenic determinant(s).
1121. The composition according to item 1113, wherein the one or more vaccine adjuvant(s) comprises one or more haptenic determinant(s).
1122. The composition according to item 1113, wherein the one or more vaccine adjuvant(s) comprises one or more mineral adjuvant(s).
1123. The composition according to item 1122, wherein the one or more mineral adjuvant(s) comprises one or more aluminium compounds such as one or more aluminium salt(s).
1124. The composition according to item 1122, wherein the one or more mineral adjuvant(s) comprises aluminium hydroxide.
1125. The composition according to item 1113, wherein the one or more vaccine adjuvant(s) comprises one or more bacterial adjuvant(s).
1126. The composition according to item 1125, wherein one or more bacterial adjuvant(s) are purified.
1127. The composition according to item 1125, wherein one or more bacterial adjuvant(s) are chemically purified.
1128. The composition according to item 1125, wherein one or more bacterial adjuvant(s) are synthesized.
1129. The composition according to item 1125, wherein one or more bacterial adjuvant(s) comprises muramyl dipeptides.
1130. The composition according to item 1125, wherein one or more bacterial adjuvant(s) comprises lipid A.
1131. The composition according to item 1125, wherein one or more bacterial adjuvant(s) comprises Interleukin 1.
1132. The composition according to item 1125, wherein one or more bacterial adjuvant(s) comprises Interleukin 2.
1133. The composition according to item 1125, wherein one or more bacterial adjuvant(s) comprises one or more cloned host mediator(s).
1134. The composition according to item 1125, wherein one or more bacterial adjuvant(s) comprises *Bordetella pertussis*.
1135. The composition according to item 1125, wherein one or more bacterial adjuvant(s) comprises one or more lipopolysaccharide(s).
1136. The composition according to item 1125, wherein one or more bacterial adjuvant(s) comprises Freund's Complete Adjuvant (FCA).
1137. The composition according to item 1125, wherein one or more bacterial adjuvant(s) comprises Titermax.
1138. The composition according to item 1125, wherein one or more bacterial adjuvant(s) comprises ISCOMS.
1139. The composition according to item 1125, wherein one or more bacterial adjuvant(s) comprises Quil A.
1140. The composition according to item 1125, wherein one or more bacterial adjuvant(s) comprises ALUN.
1141. The composition according to item 1125, wherein one or more bacterial adjuvant(s) comprises one or more Lipid A derivatives.

1142. The composition according to item 1125, wherein one or more bacterial adjuvant(s) comprises one or more choleratoxin derivatives.

1143. The composition according to item 1125, wherein one or more bacterial adjuvant(s) comprises one or more HSP derivatives.

1144. The composition according to item 1125, wherein one or more bacterial adjuvant(s) comprises one or more LPS derivatives.

1145. The composition according to item 1125, wherein one or more bacterial adjuvant(s) comprises one or more synthetic peptide matrixes.

1146. The composition according to item 1125, wherein one or more bacterial adjuvant(s) comprises GMDP.

1147. The composition according to item 1125, wherein one or more bacterial adjuvant(s) comprises one or more lipopolysaccharide(s) and/or derivatis thereof.

1148. The composition according to item 1125, wherein one or more bacterial adjuvant(s) comprises one or more lipopolysaccharide(s) and/or derivatis thereof in combination with one or more liposome(s).

1149. The composition according to item 1125, wherein one or more bacterial adjuvant(s) comprises one or more lipopolysaccharide(s) and/or derivatis thereof in combination with one or more lipid emulsion(s).

1150. The composition according to item 1113, wherein the one or more vaccine adjuvant(s) comprises one or more plant adjuvant(s).

1151. The composition according to item 1150, wherein the one or more plant adjuvant(s) comprises saponin.

1152. The composition according to item 1113, wherein the one or more vaccine adjuvant(s) comprises one or more animal products adjuvant(s).

1153. The composition according to item 1152, wherein the one or more animal products adjuvant(s) comprises chitin.

1154. The composition according to item 1113, wherein the one or more vaccine adjuvant(s) comprises one or more synthetic adjuvant(s).

1155. The composition according to item 1113, wherein the one or more vaccine adjuvant(s) comprises one or more host adjuvant(s).

1156. The composition according to item 1113, wherein the one or more vaccine adjuvant(s) comprises one or more antigens precipitated with aluminum salt(s).

1157. The composition according to item 1113, wherein the one or more vaccine adjuvant(s) comprises one or more antigens mixed with or adsorbed to performed aluminum compounds.

1158. The composition according to item 1113, wherein the one or more vaccine adjuvant(s) comprises one or more oil emulsion(s).

1159. The composition according to item 1113, wherein the one or more vaccine adjuvant(s) comprises one or more liposome(s).

1160. The composition according to item 1113, wherein the one or more vaccine adjuvant(s) comprises one or more synthetic polymer(s).

1161. The composition according to item 1113, wherein the one or more vaccine adjuvant(s) act through antigen localization and delivery.

1162. The composition according to item 1113, wherein the one or more vaccine adjuvant(s) act by direct effects on cells making up the immune system, such as macrophages and lymphocytes.

1163. The composition according to item 1113, wherein the one or more vaccine adjuvant(s) act by creation of an antigen depot.

1164. The composition according to item 1113, wherein the one or more vaccine adjuvant(s) comprises Alhydrogel.

1165. The composition according to item 1113, wherein the one or more vaccine adjuvant(s) comprises MF59 and/or the proprietary Montanide ISA720.

1166. The composition according to item 1113, wherein the one or more vaccine adjuvant(s) selected from the group consisting of $AlK(SO_4)_2$, $AlNa(SO_4)_2$, $AlNH_4(SO_4)$, silica, alum, $Al(OH)_3$, $Ca_3(PO_4)_2$, kaolin, carbon, aluminum hydroxide, muramyl dipeptides, N-acetyl-muramyl-L-threonyl-D-isoglutamine (thr-DMP), N-acetyl-nornuramyl-L-alanyl-D-isoglutamine (CGP 11687, also referred to as nor-MDP), N-acetylmuramyul-L-alanyl-D-isoglutaminyl-L-alanine-2-(1'2'-dipalmitoyl-sn-glycero-3-hydroxphosphoryloxy)-ethylamine (CGP 19835A, also referred to as MTP-PE), RIBI (MPL+TDM+CWS) in a 2% squalene/Tween-80® emulsion, lipopolysaccharides and its various derivatives, including lipid A, Freund's Complete Adjuvant (FCA), Freund's Incomplete Adjuvants, Merck Adjuvant 65, polynucleotides (for example, poly IC and poly AU acids), wax D from *Mycobacterium*, tuberculosis, substances found in *Corynebacterium parvum, Bordetella pertussis*, and members of the genus *Brucella*, liposomes or other lipid emulsions, Titermax, ISCOMS, Quil A, ALUN (see US 58767 and U.S. Pat. No. 5,554,372), Lipid A derivatives, choleratoxin derivatives, HSP derivatives, LPS derivatives, synthetic peptide matrixes or GMDP, Interleukin 1, Interleukin 2, Montanide ISA-51 and QS-21, Freund's complete or incomplete adjuvant, and killed *B. pertussis* organisms, used e.g. in combination with alum precipitated antigen.

1167. The composition according to any of items 1 to 1166, wherein the composition comprises at least one biologically active molecule such as from 1 to 3, 1 to 4, 1 to 5, 1 to 6, 1 to 7, 1 to 8, 1 to 9, 1 to 10, or 1 to more than 10; 2 to 3, 2 to 4, 2 to 5, 2 to 6, 2 to 7, 2 to 8, 2 to 9, 2 to 10, or 2 to more than 10; 3 to 4, 3 to 5, 3 to 6, 3 to 7, 3 to 8, 3 to 9, 3 to 10, or 3 to more than 10; 4 to 5, 4 to 6, 4 to 7, 4 to 8, 4 to 9, 4 to 10, or 4 to more than 10; 5 to 6, 5 to 7, 5 to 8, 5 to 9, 5 to 10, or 5 to more than 10; 6 to 7, 6 to 8, 6 to 9, 6 to 10, or 6 to more than 10; 7 to 8, 7 to 9, 7 to 10, or 7 to more than 10; 8 to 9, 8 to 10, or 8 to more than 10; 9 to 10, or 9 to more than 10 different biologically active molecules.

1168. The composition according to any of items 1 to 1166, wherein the composition comprises two different biologically active molecules termed A and B, wherein the ratio of A:B can be selected from the group consisting of 1:1, 1:2, 1:3, 1:4, 1:5, 1:10, 2:3, and 3:5.

1169. The composition according to any of items 1 to 1166, wherein the composition comprises three different biologically active molecules termed A, B and C, wherein the ratio of A:B:C can be selected from the group consisting of 1:1:1, 1:2:1, 1:3:1, 1:4:1, 1:5:1, 1:10:1,2:1:1, 2:1:2, 2:3:2, and 3:5:8.

1170. The composition according to any of items 1 to 1166, wherein the composition comprises five different biologically active molecules termed A, B, C, D, and E, wherein the ratio of A:B:C:D:E can be selected from the group consisting of 1:1:1:1:1, 1:1:1:1:2, 1:1:1:2:2, 1:2:2:2:2, 2:4:3:6:5, 4:6:8:1:1, and 10:1:2:5:2.

1171. A method of making the composition according to item 1-1170.

1172. A method for vaccination comprising administration to an individual in need thereof an effective amount of the composition according to item 1-1170.

1173. The method for vaccination according to item 1172, wherein each dosage unit of said composition comprises in the range of 0.01 to 1 µg, such as in the range of 0.05 to 1 µg, for example in the range of 0.1 to 1 µg, such as in the range of 0.05 to 1 µg, for example in the range of 0.1 to 1 µg, such as in the range of 0.05 to 0.8 µg, for example in the range of 0.05 to 0.6 µg, such as in the range of 0.05 to 0.4 µg, for example in the range of 0.05 to 0.2 µg, such as in the range of 0.1 to 0.8 µg, for example in the range of 0.1 to 0.6 µg, such as in the range of 0.1 to 0.5 µg, for example in the range of 0.1 to 0.4 µg, such as in the range of 0.1 to 0.3 µg, for example in the range of 0.1 to 0.2 µg of pharmamer and/or peptide.

1174. The method for vaccination according to item 1172, wherein the daily dosage of the composition comprises pharmamer in the range from 0.001 to 1,000 mg per adult human/per day, such as from 0.001 to 0.005 mg per adult human/per day, for example from 0.005 to 0.01 mg per adult human/per day, such as from 0.01 to 0.05 mg per adult human/per day, for example from 0.05 to 0.1 mg per adult human/per day, such as from 0.1 to 0.5 mg per adult human/per day, for example from 0.5 to 1 mg per adult human/per day, such as from 1 to 5 mg per adult human/per day, for example from 5 to 10 mg per adult human/per day, such as from 10 to 50 mg per adult human/per day, for example from 50 to 100 mg per adult human/per day, such as from 100 to 500 mg per adult human/per day, for example from 500 to 1000 mg per adult human/per day.

1175. The method for vaccination according to item 1172, wherein the vaccination comprises oral administration of scored or unscored tablets containing e.g. 0.01, 0.05, 0.1, 0.5, 1.0, 2.5, 5.0, 10.0, 15.0, 25.0, or 50.0 milligrams of the active ingredient for the symptomatic adjustment of the dosage to the patient to be treated.

1176. The method for vaccination according to item 1172, wherein the composition is administered at a dosage level of from about 0.0001 mg/kg to about 100 mg/kg of body weight per day, such as from about 0.0001 mg/kg to about 0.0005 mg/kg of body weight per day, for example from about 0.0005 mg/kg to about 0.001 mg/kg of body weight per day, such as from about 0.001 mg/kg to about 0.005 mg/kg of body weight per day, for example from about 0.005 mg/kg to about 0.01 mg/kg of body weight per day, such as from about 0.01 mg/kg to about 0.05 mg/kg of body weight per day, for example from about 0.05 mg/kg to about 0.1 mg/kg of body weight per day, such as from about 0.1 mg/kg to about 0.5 mg/kg of body weight per day, for example from about 0.5 mg/kg to about 1 mg/kg of body weight per day, such as from about 1 mg/kg to about 5 mg/kg of body weight per day, for example from about 5 mg/kg to about 10 mg/kg of body weight per day, such as from about 10 mg/kg to about 50 mg/kg of body weight per day, for example from about 50 mg/kg to about 100 mg/kg of body weight per day.

1177. The method for vaccination according to item 1172, wherein the composition is administered at a dosage level comprising of from about 0.0001 mg/kg to about 100 mg/kg of body weight per day, such as from about 0.0001 mg/kg to about 0.0005 mg/kg of body weight per day, for example from about 0.0005 mg/kg to about 0.001 mg/kg of body weight per day, such as from about 0.001 mg/kg to about 0.005 mg/kg of body weight per day, for example from about 0.005 mg/kg to about 0.01 mg/kg of body weight per day, such as from about 0.01 mg/kg to about 0.05 mg/kg of body weight per day, for example from about 0.05 mg/kg to about 0.1 mg/kg of body weight per day, such as from about 0.1 mg/kg to about 0.5 mg/kg of body weight per day, for example from about 0.5 mg/kg to about 1 mg/kg of body weight per day, such as from about 1 mg/kg to about 5 mg/kg of body weight per day, for example from about 5 mg/kg to about 10 mg/kg of body weight per day, such as from about 10 mg/kg to about 50 mg/kg of body weight per day, for example from about 50 mg/kg to about 100 mg/kg of body weight per day of pharmamer.

1178. The method for vaccination according to item 1172, wherein the composition is administered at a dosage level comprising of from about 0.0001 mg/kg to about 100 mg/kg of body weight per day, such as from about 0.0001 mg/kg to about 0.0005 mg/kg of body weight per day, for example from about 0.0005 mg/kg to about 0.001 mg/kg of body weight per day, such as from about 0.001 mg/kg to about 0.005 mg/kg of body weight per day, for example from about 0.005 mg/kg to about 0.01 mg/kg of body weight per day, such as from about 0.01 mg/kg to about 0.05 mg/kg of body weight per day, for example from about 0.05 mg/kg to about 0.1 mg/kg of body weight per day, such as from about 0.1 mg/kg to about 0.5 mg/kg of body weight per day, for example from about 0.5 mg/kg to about 1 mg/kg of body weight per day, such as from about 1 mg/kg to about 5 mg/kg of body weight per day, for example from about 5 mg/kg to about 10 mg/kg of body weight per day, such as from about 10 mg/kg to about 50 mg/kg of body weight per day, for example from about 50 mg/kg to about 100 mg/kg of body weight per day of peptide(s).

1179. The method for vaccination according to item 1172, wherein the composition is administered at a dosage level comprising of from about 0.0001 mg/kg to about 100 mg/kg of body weight per day, such as from about 0.0001 mg/kg to about 0.0005 mg/kg of body weight per day, for example from about 0.0005 mg/kg to about 0.001 mg/kg of body weight per day, such as from about 0.001 mg/kg to about 0.005 mg/kg of body weight per day, for example from about 0.005 mg/kg to about 0.01 mg/kg of body weight per day, such as from about 0.01 mg/kg to about 0.05 mg/kg of body weight per day, for example from about 0.05 mg/kg to about 0.1 mg/kg of body weight per day, such as from about 0.1 mg/kg to about 0.5 mg/kg of body weight per day, for example from about 0.5 mg/kg to about 1 mg/kg of body weight per day, such as from about 1 mg/kg to about 5 mg/kg of body weight per day, for example from about 5 mg/kg to about 10 mg/kg of body weight per day, such as from about 10 mg/kg to about 50 mg/kg of body weight per day, for example from about 50 mg/kg to about 100 mg/kg of body weight per day of biologically active molecule.

1180. The method for vaccination according to item 1172, wherein the composition is administered at a dosage level comprising of from about 0.0001 mg/kg to about 100 mg/kg of body weight per day, such as from about 0.0001 mg/kg to about 0.0005 mg/kg of body weight per day, for example from about 0.0005 mg/kg to about 0.001 mg/kg of body weight per day, such as from about 0.001 mg/kg to about 0.005 mg/kg of body weight per day, for example from about 0.005 mg/kg to about 0.01 mg/kg of body weight per day, such as from about 0.01 mg/kg to about 0.05 mg/kg of body weight per day, for example from about 0.05 mg/kg to about 0.1 mg/kg of body weight per day, such as from about 0.1 mg/kg to about 0.5 mg/kg of body weight per day, for example from about 0.5 mg/kg to about 1 mg/kg of body weight per day, such as from about 1 mg/kg to about 5 mg/kg of body weight per day, for example from about 5 mg/kg to about 10 mg/kg of body weight per day, such as from about 10 mg/kg to about 50 mg/kg of body weight per day, for example from about 50 mg/kg to about 100 mg/kg of body weight per day of adjuvans.

1181. The method for vaccination according to item 1172, wherein the individual in need thereof is a mammal.

1182. The method for vaccination according to item 1172, wherein the individual in need thereof is a human being.
1183. The method for vaccination according to item 1172, wherein the individual in need thereof is a newborn.
1184. The method for vaccination according to item 1172, wherein the individual in need thereof is a child.
1185. The method for vaccination according to item 1172, wherein the individual in need thereof is an adult.
1186. The method for vaccination according to item 1172, wherein the individual in need thereof is a woman.
1187. The method for vaccination according to item 1172, wherein the individual in need thereof is a man.
1188. The method for vaccination according to item 1172, wherein the individual in need thereof is of any age such as from newborn to 120 years old, for example from 0 to 6 months, such as from 6 to 12 months, for example from 1 to 5 years, such as from 5 to 10 years, for example from 10 to 15 years, such as from 15 to 20 years, for example from 20 to 25 years, such as from 25 to 30 years, for example from 30 to 35 years, such as from 35 to 40 years, for example from 40 to 45 years, such as from 45 to 50 years, for example from 50 to 60 years, such as from 60 to 70 years, for example from 70 to 80 years, such as from 80 to 90 years, for example from 90 to 100 years, such as from 100 to 110 years, for example from 110 to 120 years.
1189. The method for vaccination according to item 1172, wherein the individual in need thereof is of any race such as a Caucasian, a black person, an East Asian person, a person of Mongoloid race, a person of Ethiopian race, a person of Negroid race, a person of American Indian race, or a person of Malayan race.
1190. The method for vaccination according to item 1172, wherein the individual in need thereof is healthy.
1191. The method for vaccination according to item 1172, wherein the individual in need thereof is ill.
1192. The method for vaccination according to item 1172, wherein the individual in need thereof is diagnosed with one or more diseases.
1193. The method for vaccination according to item 1172, wherein the individual in need thereof has one or more symptoms of one or more diseases.
1194. The method for vaccination according to item 1172, wherein the individual in need thereof is asymptomatic.
1195. The method for vaccination according to item 1172, wherein the individual in need thereof is genetically disposed for one or more diseases.
1196. The method for vaccination according to item 1172, wherein the individual in need thereof is an animal.
1197. The method for vaccination according to item 1172, wherein the individual in need thereof is a bird.
1198. The method for vaccination according to item 1172, wherein the individual in need thereof is an insect.
1199. The method for vaccination according to item 1172, wherein the individual in need thereof is a plant.
1200. The method for vaccination according to item 1172, wherein the method comprises administration of said composition by oral administration.
1201. The method for vaccination according to item 1172, wherein the method comprises administration of said composition by sublingual administration.
1202. The method for vaccination according to item 1172, wherein the method comprises administration of said composition by nasal administration.
1203. The method for vaccination according to item 1172, wherein the method comprises administration of said composition by inhalation.
1204. The method for vaccination according to item 1172, wherein the method comprises administration of said composition by injection.
1205. The method for vaccination according to item 1172, wherein the method comprises administration of said composition by intravenous administration.
1206. The method for vaccination according to item 1172, wherein the method comprises administration of said composition by intramuscular administration.
1207. The method for vaccination according to item 1172, wherein the method comprises administration of said composition by intrathecal administration.
1208. The method for vaccination according to item 1172, wherein the method comprises administration of said composition by subcutan administration.
1209. The method for vaccination according to item 1172, wherein the method comprises administration of said composition by implantation.
1210. The method for vaccination according to item 1172, wherein the method comprises administration of said composition by rectal administration.
1211. The method for vaccination according to item 1172, wherein the method comprises administration of said composition by vaginal administration.
1212. The method for vaccination according to item 1172, wherein the method comprises administration of said composition by the ocular route.
1213. The method for vaccination according to item 1172, wherein the method comprises administration of said composition by applying it to the skin (cutaneously) for a local (topical) effect.
1214. The method for vaccination according to item 1172, wherein the method comprises administration of said composition by applying it to the skin (cutaneously) for body-wide (systemic) effect.
1215. The method for vaccination according to item 1172, wherein the method comprises administration of said composition by delivering it through the skin (transdermally) for a systemic effect.
1216. The method for vaccination according to item 1172, wherein the method comprises administration of said composition by inter peritoneal injection.
1217. The method for vaccination according to item 1172, wherein the method comprises administration of said composition by transmucosal administration.
1218. The method for vaccination according to item 1172, wherein the method comprises administration of said composition by inoculation.
1219. The method for vaccination according to item 1172, wherein the method comprises administration of a single dose of said composition.
1220. The method for vaccination according to item 1172, wherein the method comprises administration of several doses of said composition such as 2, 3, 4, 5, 6, 7, 8, 9, or 10 doses.
1221. The method for vaccination according to item 1172, wherein the method comprises administration of said composition only once.
1222. The method for vaccination according to item 1172, wherein the method comprises administration of said composition more than once such as 2, 3, 4, 5, 6, 7, 8, 9 or 10 times.
1223. The method for vaccination according to item 1172, wherein the method comprises administration of said composition more than once with administration with intervals of a day.

1224. The method for vaccination according to item 1172, wherein the method comprises administration of said composition more than once with administration with intervals of a days, such as 2, 3, 4, 5, 6, 7, 8, 9, 10, 11, 12, 13, or 14 days.
1225. The method for vaccination according to item 1172, wherein the method comprises administration of said composition more than once with administration with intervals of about a week.
1226. The method for vaccination according to item 1172, wherein the method comprises administration of said composition more than once with administration with intervals of about two weeks.
1227. The method for vaccination according to item 1172, wherein the method comprises administration of said composition more than once with administration with intervals of about three weeks.
1228. The method for vaccination according to item 1172, wherein the method comprises administration of said composition more than once with administration with intervals of about a month.
1229. The method for vaccination according to item 1172, wherein the method comprises administration of said composition more than once with administration with intervals of several months, such as 2, 3,4, 5, 6, 7, 8, 9, 10, 11 or 12 months.
1230. The method for vaccination according to item 1172, wherein the method comprises administration of said composition more than once with administration with intervals of years, such as 2, 3, 4, 5, 6, 7, 8, 9, 10, 12, 14, 16, 18, 20, 25, 30, 40, 50, 60, 70, 80, 90, 100 or 110 years.
1231. The method for vaccination according to item 1172, wherein the method comprises a continuous administration regime of said composition e.g. like up to four doses per week, followed by one month without administrations, followed by up to four doses per week.
1232. The method for vaccination according to item 1172, wherein the method comprises a vaccination protocol where administration is performed e.g. on week 0, 4, 8, and 16; or on week 0, 2, 4, 6, 8, 10, 12, and 14; or on week 0, 5, 11, 17; or on month 0, 1, and 2; or on day 0, 7, and 30; or every year.
1233. The method for vaccination according to item 1172, wherein the method comprises administration of said composition more than once and wherein the amount of phamamer and/or peptide is increased from the first administration to one or more of the subsequent administrations.
1234. The method for vaccination according to item 1172, wherein the method comprises administration of said composition more than once and wherein the amount of phamamer and/or peptide is decreased from the first administration to one or more of the subsequent administrations.
1235. The method for vaccination according to item 1172, wherein the method comprises administration of said composition more than once and wherein the ratio of biologically active molecules in said composition is modified from the first administration to one or more of the subsequent administrations.
1236. The method for vaccination according to item 1172, wherein the method comprises administration of said composition more than once and wherein the type of adjuvant(s) in said composition is modified from the first administration to one or more of the subsequent administrations.
1237. The method for vaccination according to item 1172, wherein the method comprises administration of said composition more than once and wherein the amount of one or more adjuvant(s) in said composition is modified from the first administration to one or more of the subsequent administrations.
1238. The method for vaccination according to item 1172, wherein the method comprises administration of said composition more than once and wherein the combination of adjuvants in said composition is modified from the first administration to one or more of the subsequent administrations.
1239. The method for vaccination according to item 1172, wherein the method comprises use of an administration protocol linked to age of the individual in need of said vaccine.
1240. The method for vaccination according to item 1172, wherein the method comprises use of an administration protocol for childhood vaccines e.g. wherein the vaccine is administered at the age of 3 month, 5, month, and 12 month; or 3 month, 5, month, 12 month, and 5 years; or 15 month, and 4 years.
1241. The method for vaccination according to item 1172, wherein the method comprises administration of said composition together with administration of one or more medicament, wherein the administration can be simultaneously or sequentially in any order.
1242. The method for vaccination according to item 1172, wherein the composition is administered together with one or more adjuvants.
1243. The method for vaccination according to item 1172, wherein the composition is administered simultaneously with one or more adjuvants.
1244. The method for vaccination according to item 1172, wherein the composition is administered together with one or more adjuvants sequentially in any order.
1245. The method for vaccination according to item 1172, wherein the vaccination is prophylactic.
1246. The method for vaccination according to item 1172, wherein the vaccination if ameliorating.
1247. The method for vaccination according to item 1172, wherein the vaccination is curative.
1248. A method for monitoring a vaccine response comprising use of the composition according to item 1-1170.
1249. A kit-of-parts comprising the composition according to item 1-1170 and at least one addition component.
1250. Use of the kit-of-parts according to item 1249 for vaccination of an individual in need thereof.
1251. Use of the kit-of-parts according to item 1249 for monitoring of a vaccine response.
1252. The composition according to item 1, wherein the one or more pharmamers comprises one or more HIV and/or SIV vaccines.
1253. The composition according to item 1, wherein the one or more pharmamers comprises a dextran carrier.
1254. The composition according to item 1, wherein the one or more pharmamers comprises a dextran carrier derivatized by attachment of Streptavidin e.g. such as 8.6 Steptavidin molecules are attached per Dextran molecule.
1255. The composition according to item 1, wherein the one or more pharmamers comprises a dextran carrier with a molecular weight of 270 kDa.
1256. The composition according to item 1, wherein the one or more pharmamers comprises a dextran carrier with Simian MHC class 1 molecules attached.
1257. The composition according to item 1, wherein the one or more pharmamers comprises a dextran carrier with Mamu-A*01(CTPYDINQM) (SEQ ID NO 9569) attached.

1258. The composition according to item 1, wherein the one or more pharmamers comprises a dextran carrier with Mamu-A*08(KPCVKLTP) attached (SEQ ID NO 9570).
1259. The composition according to item 1, wherein the one or more pharmamers comprises a dextran carrier with Mamu-B*17(IRFPKTFGW) (SEQ ID NO 9571) attached.
1260. The composition according to items 1257 to 1259, wherein attachment is done via a COOH-terminal Biotin molecule on the recombinant Mamu heavy chain to streptavidin molecules on the dextran carrier.
1261. The composition according to item 1, wherein the one or more pharmamers comprises one or more biotinylated synthetic Mamu class 2 peptides.
1262. The composition according to item 1, wherein the one or more pharmamers comprises Mamu-DQB1*0601 (EFVRFDSAVGEYRAV) (SEQ ID NO 9572).
1263. The composition according to item 1, wherein the one or more pharmamers comprises Mamu-DQB1*1808 (EFVGFDSYLGVYRPV) (SEQ ID NO 9573).
1264. The composition according to item 1, wherein the one or more pharmamers comprises Mamu-DRB*W201 (TREDILERERAQVDTFY) (SEQ ID NO 9574).
1265. The composition according to item 1, wherein the one or more pharmamers comprises recombinant HSP70pep3Bio fragments (a biotinylated HSP70 fragment spanning amino acid residues 359-609) attached to strepavidin sites.
1266. The composition according to item 1, wherein the one or more pharmamers comprises HIV-Gag (CTPYDINQM) (SEQ ID NO 9569).
1267. The composition according to item 1, wherein the one or more pharmamers comprises HIV-Env (KPCVKLTP) (SEQ ID NO 9570).
1268. The composition according to item 1, wherein the one or more pharmamers comprises Siv Nef (IRFPKTFGW) (SEQ ID NO 9571).
1269. The composition according to item 1, wherein the one or more pharmamers comprises recombinant HIV-1gp140 trimer and SIVp27 attached by Biotin-Strepavidin binding.
1270. The composition according to item 1, wherein the one or more pharmamers comprises Mamu-A*01(CTPYDINQM) (SEQ ID NO 9569), Mamu-DQB1*0601 (EFVRFDSAVGEYRAV) (SEQ ID NO 9572) class 2 peptide, HSP70pep3Bio, and Dextran carrier (in the molar ratio 10:10:4:1).
1271. The composition according to item 1, wherein the one or more pharmamers comprises Mamu-A*08 (KPCVKLTP) (SEQ ID NO 9570), Mamu-DQB1*1808 (EFVGFDSYLGVYRPV) (SEQ ID NO 9573) class 2 peptide, HSP70pep3Bio and Dextran carrier (in the molar ratio 10:10:4:1).
1272. The composition according to item 1, wherein the one or more pharmamers comprises Mamu-B*17(IRFPKTFGW) (SEQ ID NO 9571), Mamu-DRB*W201 (TREDILERERAQVDTFY) (SEQ ID NO 9574) class 2 peptide, HSP70pep3Bio and Dextran carrier (in the molar ratio 10:10:4:1).
1273. The composition according to item 1, wherein the one or more pharmamers comprises Sivp27, HIV-1gp140trimer, HSP70pep3Bio and Dextran carrier (in the molar ratio 3:10:4).
1274. The composition according to item 1, wherein the one or more pharmamers are absorbed into the adjuvant Alhydrogel (Aluminiumhydroxide gel) as specified by the manufacturer.
1275. The composition according to item 1, wherein the one or more pharmamers comprises Human MHC class 1 molecules.
1276. The composition according to item 1, wherein the one or more pharmamers comprises HLA-A*0101(IVDCLTEMY) (SEQ ID NO 9575).
1277. The composition according to item 1, wherein the one or more pharmamers comprises HLA-A*0201 (GLIQLVEGV) (SEQ ID NO 9576).
1278. The composition according to item 1, wherein the one or more pharmamers comprises HLA-A*0301(RIAAWMATY) (SEQ ID NO 9577).
1279. The composition according to item 1, wherein the one or more pharmamers comprises HLA-A*1101 (IVTDFSVIK) (SEQ ID NO 9578).
1280. The composition according to item 1, wherein the one or more pharmamers comprises attachment a COOH-terminal Biotin molecule on recombinant HLA heavy chain to the carrier strepavidin molecules.
1281. The composition according to item 1, wherein the one or more pharmamers comprises biotinylated recombinant HLA class 2 protein HLA-DR*0401 and recombinant HSP70pep3Bio fragments (a biotinylated HSP70 fragment spanning amino acid residues 359-609) attached to strepavidin sites.
1282. The composition according to item 1, wherein the one or more pharmamers comprises USP9Y, ubiquitin specific protease 9 (IVDCLTEMY) (SEQ ID NO 9575).
1283. The composition according to item 1, wherein the one or more pharmamers comprises TRAG-3_4 (GLIQLVEGV) (SEQ ID NO 9576).
1284. The composition according to item 1, wherein the one or more pharmamers comprises BCL2L1 (RIAAWMATY) (SEQ ID NO 9577).
1285. The composition according to item 1, wherein the one or more pharmamers comprises EBV EBNA3B (IVTDFSVIK) (SEQ ID NO 9578).
1286. The composition according to item 1, wherein the one or more pharmamers comprises a HLA class 2 complex without a peptide in the binding groove.
1287. The composition according to item 1, wherein the one or more pharmamers comprises a HLA class 2 complex containing unknown peptides derived from either serum or S2 production cells.
1288. The composition according to item 1, wherein the one or more pharmamers comprises HLA-A*0101(IVDCLTEMY) (SEQ ID NO 9575), HLA-DR*0401 class 2, HSP70pep3Bio, and Dextran carrier (in the molar ratio 10:10:4:1).
1289. The composition according to item 1, wherein the one or more pharmamers comprises HLA-A*0201 (GLIQLVEGV) (SEQ ID NO 9576), HLA-A*0301 (RIAAWMATY) (SEQ ID NO 9577), HSP70pep3Bio, and Dextran carrier (in the molar ratio 10:10:4:1).
1290. The composition according to item 1, wherein the one or more pharmamers comprises HLA-A*1101(IVTDFSVIK) (SEQ ID NO 9578), HSP70pep3Bio, and Dextran carrier (in the molar ratio 10:4:1).
1291. The composition according to item 1, wherein the one or more pharmamers are emulsified with the adjuvant Titermax Gold as specified by the manufacturer.
1292. The composition according to item 1, wherein the one or more pharmamers comprises recombinant HIV-1gp140 trimer and SIVp27 attached by Biotin-Strepavidin binding.
1293. The composition according to item 1, wherein the one or more pharmamers comprises biotinylated recombinant HSP70pep3Bio-CCR5-tripeptide fragment, a biotinylated fusion protein consisting of the HSP70 fragment spanning amino acid residues 359-609 plus the antigenic CCR5 loops, N-terminal loop, Loop1 and Loop2, attached to strepavidin sites.

1294. The composition according to item 1, wherein the one or more pharmamers comprises the CCR5 peptides representing the three antigenic loops (N-terminal (MNYQVSSPIYNINYYTSEPC) (SEQ ID NO 9579); Loop1 (HYAAAQWNFGNTMCQ) (SEQ ID NO 9580); Loop2 (YSSHFPYSQYQFWKNFQTLK) (SEQ ID NO 9581)).

1295. The composition according to item 1, wherein the one or more pharmamers comprises Mamu-A*01(CTPYDINQM) (SEQ ID NO 9569), HSP70pep3Bio-CCR5-tripeptide and Dextran carrier (in the molar ratio 13:10:1).

1296. The composition according to item 1, wherein the one or more pharmamers comprises Mamu-A*08 (KPCVKLTP) (SEQ ID NO 9570), HSP70pep3Bio-CCR5-tripeptide and Dextran carrier (in the molar ratio 13:10:1).

1297. The composition according to item 1, wherein the one or more pharmamers comprises Mamu-B*17(IRFPKTFGW) (SEQ ID NO 9571), HSP70pep3Bio-CCR5-tripeptide and Dextran carrier (in the molar ratio 13:10:1).

1298. The method for vaccination according to item 1172, wherein the composition is administered as intramuscular injections at time points 0, 4, 8, and 16 weeks such that a full dose is given at 0 weeks and half-full dose at 4, 8, and 16 weeks.

1299. The method for vaccination according to item 1172, wherein the composition is administered as intramuscular injections at time points 0, 2, 4, 6, 8, 10, 12 and 14 weeks such that a full dose is given at each time point.

1300. The composition according to item 1, wherein the composition is designed to elicit a multifunctional immune response i.e. a composite immune responses directed against the adaptive and the innate immune system; and/or both parts of the adaptive system i.e. the humoral and the cellular part.

1301. The composition according to item 1, wherein the composition comprises one or more HLA class 1 and/or class 2 molecules.

1302. The composition according to item 1, wherein the composition comprises one or more HLA class 1 molecules that are folded or partly folded with human b2Microglobulin and a peptide fitting into the binding groove.

1303. The composition according to item 1, wherein the composition comprises one or more complete, partial or otherwise modified HLA class 1 heavy chain(s).

1304. The composition according to item 1, wherein the composition comprises one or more HLA class 2 molecules consisting of folded or partly folded alpha- and beta-chains with or without a peptide in the binding groove.

1305. The composition according to item 1, wherein the composition comprises one or more complete, partial or otherwise modified HLA class 2 alpha- and beta-chains.

1306. The composition according to item 1, wherein the composition comprises one or more binding-peptides derived from HIV specific proteins such as Gag-Pol, Pr55 (Gag), Vif, Vpr, Tat, Rev, Vpu, Nef, gp160 and derivatives such as gp120, gp41 and gp140.

1307. The composition according to item 1, wherein the composition comprises one or more binding-peptides that are HIV unrelated.

1308. The composition according to item 1, wherein the composition comprises HLA class 1 peptides derived from regions of the class 1 heavy chain.

1309. The composition according to item 1, wherein the composition comprises HLA class 2 peptides derived from regions of the class 2 alpha and/or beta chain.

1310. The composition according to item 1, wherein the composition comprises CD4 or part(s) hereof.

1311. The composition according to item 1, wherein the composition comprises CCR 5 (Chemokine Receptor 5) or part(s) hereof.

1312. The composition according to item 1, wherein the composition comprises the extracellular peptide-loops of CCR5.

1313. The composition according to item 1, wherein the composition comprises HSP70 or part(s) thereof.

1314. The composition according to item 1, wherein the composition comprises CXCR4 or part(s) hereof.

1315. The composition according to item 1, wherein the composition comprises CCR 2 (Chemokine Receptor 2) or part(s) hereof.

1316. The composition according to item 1, wherein the composition comprises CX3CR1 or part(s) hereof.

1317. The composition according to item 1, wherein the composition comprises SDF-1 or part(s) hereof.

1318. The composition according to item 1, wherein the composition comprises US28 or part(s) hereof.

1319. The composition according to item 1, wherein the composition comprises HIV viral specific proteins i.e. Gag-Pol, Pr55(Gag), Vif, Vpr, Tat, Rev, Vpu, Nef, gp160 and derivatives such as but not limited to gp120, gp41 and gp140.

1320. The composition according to item 1, wherein the composition comprises Simian Mamu class 1 and/or class 2 molecules (Mokey major histocompatibility antigens).

1321. The composition according to item 1, wherein the composition comprises one or more Mamu class 1 molecules folded or partly folded with one or more human b2Microglobulin and a peptide fitting into the binding groove.

1322. The composition according to item 1, wherein the composition comprises one or more complete, partial or otherwise modified Mamu class 1 heavy chain(s).

1323. The composition according to item 1, wherein the composition comprises one or more Mamu class 2 molecules consisting of folded or partly folded alpha- and beta-chains with or without a peptide in the binding groove.

1324. The composition according to item 1, wherein the composition comprises one or more complete, partial or otherwise modified Mamu class 2 alpha- and beta-chains.

1325. The composition according to item 1, wherein the composition comprises one or more binding-peptides derived from SIV specific proteins such as Gag-Pol, Gag, Vif, Vpx, Envelope protein, and/or Nef.

1326. The composition according to item 1, wherein the composition comprises one or more binding-peptides that are SIV unrelated.

1327. The composition according to item 1, wherein the composition comprises Mamu class 1 peptides derived from regions of the class 1 heavy chain.

1328. The composition according to item 1, wherein the composition comprises Mamu class 2 peptides derived from regions of the class 2 alpha and/or beta chain.

1329. The composition according to item 1, wherein the composition comprises SIV viral specific proteins i.e. Gag-Pol, Gag, Vif, Vpx, Envelope protein, Nef; HSP70 (70 kD Heat-shock protein) or part(s) hereof.

1330. The method for vaccination according to item 1172, wherein the composition is administered at the cervico-vaginal mucosa i.e. vaginally or IM i.e. intra-muscular. T 1331. The method for vaccination according to item 1172, wherein the composition is administered alone or together with additional adjuvant(s) such as but not limited to Titermax Gold, Alhydrogel (Aluminium-hydroxide), MF59 and/or the proprietary Montanide ISA720.
1332. The method for vaccination according to item 1172, wherein the vaccination is for treatment of one or more diseases caused by a viral infection.
1333. The method for vaccination according to item 1332, wherein viral infection is caused by dsDNA vira such as Adenoviruses, Herpesviruses, Poxviruses.
1334. The method for vaccination according to item 1332, wherein viral infection is caused by ssDNA vira (+)sense DNA such as Parvoviruses.
1335. The method for vaccination according to item 1332, wherein viral infection is caused by dsRNA vira such as Reoviruses.
1336. The method for vaccination according to item 1332, wherein viral infection is caused by (+)ssRNA vira (+)sense RNA such as Picornaviruses and Togaviruses.
1337. The method for vaccination according to item 1332, wherein viral infection is caused by (−)ssRNA vira (−)sense RNA such as Orthomyxoviruses and Rhabdoviruses.
1338. The method for vaccination according to item 1332, wherein viral infection is caused by ssRNA-RT vira (+)sense RNA with DNA intermediate in life-cycle such as Retroviruses.
1339. The method for vaccination according to item 1332, wherein viral infection is caused by dsDNA-RT vira such as Hepadnaviruses.
1340. The method for vaccination according to item 1332, wherein viral infection is caused by one or more vira selected from the group consisting of Abelson murine leukemia virus (Ab-MLV, A-MuLV), acute laryngotracheobronchitis virus (or HPIV), Adelaide River virus, Adeno-associated virus group (Dependevirus), Adenovirus, African horse sickness virus, African swine fever virus, AIDS virus, Aleutian mink disease, parvovirus, alfalfa mosaic virus, Alphaherpesvirinae (including HSV 1 and 2 and varicella), Alpharetrovirus (Avian leukosis virus, Rous sarcoma virus), Alphavirus, alkhurma virus, ALV related virus, Amapari virus, Andean potato mottle virus, Aphthovirus, Aquareovirus, arbovirus, arbovirus C, arbovirus group A, arbovirus group B, Arenavirus group, Argentine hemorrhagic fever virus, Argentinian hemorrhagic fever virus, Arterivirus, Astrovirus, Ateline herpesvirus group, Aujezky's disease virus, Aura virus, Ausduk disease virus, Australian bat lyssavirus, Aviadenovirus, avian erythroblastosis virus, avian infectious bronchitis virus, avian leukemia virus, Avian leukosis virus (ALV), avian lymphomatosis virus, avian myeloblastosis virus, avian paramyxovirus, avian pneumoencephalitis virus, avian reticuloendotheliosis virus, avian sarcoma virus, avian type C retrovirus group, Avihepadnavirus, Avipoxvirus, B virus (Cercopithecine herpesvirus 1), B19 virus (Parvovirus B19), Babanki virus, baboon herpesvirus, bacterial virus, baculovirus, barley yellow dwarf virus, Barmah Forest virus, bean pod mottle virus, bean rugose mosaic virus, Bebaru virus, Berrimah virus, Betaherpesvirinae, betaretrovirus, Bird flu, Birnavirus, Bittner virus, BK virus, Black Creek Canal virus, bluetongue virus, Bolivian hemorrhagic fever virus, Boma disease virus, border disease of sheep virus, borna virus, bovine alphaherpesvirus 1, bovine alphaherpesvirus 2, bovine coronavirus, bovine ephemeral fever virus, bovine immunodeficiency virus, bovine leukemia virus, bovine leukosis virus, bovine mammillitis virus, bovine papillomavirus, bovine papular stomatitis virus, bovine parvovirus, bovine syncytial virus, bovine type C oncovirus, bovine viral diarrhea virus, bracovirus, broad bean mottle virus, broad bean stain virus, brome mosaic virus, Bromovirus, Buggy Creek virus, bullet shaped virus group, Bunyamwera virus, Bunyavirus, Burkitt's lymphoma virus, Bwamba Fever, Bwattany hetero virus, CA virus (Croup-associated virus/parainfluenza vius type 2), Calicivirus, California encephalitis virus, camelpox virus, canarypox virus, canid herpesvirus, canine coronavirus, canine distemper virus, canine herpesvirus, canine minute virus, canine parvovirus, Cano Delgadito virus, Capillovirus, caprine arthritis virus, caprine encephalitis virus, Caprine Herpes Virus, Capripox virus, Cardiovirus, Carlavirus, Carmovirus, carrot mottle virus, Cassia yellow blotch virus, Caulimovirus, Cauliflower mosaic virus, caviid herpesvirus 1, Cercopithecine herpesvirus 1, Cercopithecine herpesvirus 2, cereal yellow dwarf virus, Chandipura virus, Changuinola virus, channel catfish virus, Charleville virus, chickenpox virus, Chikungunya virus, chimpanzee herpesvirus, Chordopoxvirinae, chub reovirus, chum salmon virus, Closterovirus, Cocal virus, Coho salmon reovirus, coital exanthema virus, Colorado tick fever virus, Coltivirus Columbia SK virus, Commelina yellow mottle virus, Common cold virus, Comovirus, Condylomata accuminata, congenital cytomegalovirus, contagious ecthyma virus, contagious pustular dermatitis virus, Coronavirus, Corriparta virus, coryza virus, cowpea chlorotic mottle virus, cowpea mosaic virus, cowpea virus, cowpox virus, coxsackie virus, CPV (cytoplasmic polyhedrosis virus), cricket paralysis virus, Crimean-Congo hemorrhagic fever virus, croup associated virus, Cryptovirus, Cucumovirus, Cypovirus, Cytomegalovirus (HCMV or Human Herpesvirus 5 HHV-5), cytoplasmic polyhedrosis virus, Cytorhabdovirus, deer papillomavirus, Deltaretrovirus (Human T-lymphotropic virus), Deformed wing virus DWV, Dengue, Densovirus, Dependovirus, Dhori virus, Dianthovirus, diplorna virus, DNA virus, Dobrava-Belgrade Virus, Dog Flu, Drosophila C virus, duck hepatitis B virus, duck hepatitis virus 1, duck hepatitis virus 2, duovirus, Duvenhage virus, eastern equine encephalitis virus, eastern equine encephalomyelitis virus, Ebola virus, Ebola-like virus, Echovirus, echovirus 10, echovirus 28, echovirus 9, ectromelia virus, EEE virus (Eastern equine encephalitis virus), EIA virus (equine infectious anemia), EMC virus (Encephalomyocarditis), Emiliania huxleyi virus 86, encephalitis virus, encephalomyocarditis virus, Endogenous retrovirus, Enterovirus, Entomopoxvirinae, Entomopoxvirus A, Entomopoxvirus B, Entomopoxvirus C, enzyme elevating virus, epidemic hemorrhagic fever virus, epizootic hemorrhagic disease virus, Epsilonretrovirus, Epstein-Barr virus (EBV; Human herpesvirus 4 HHV-4), equid alphaherpesvirus 1, equid alphaherpesvirus 4, equid herpesvirus 2, equine abortion virus, equine arteritis virus, equine encephalosis virus, equine infectious anemia virus, equine morbillivirus, equine rhinopneumonitis virus, equine rhinovirus, Eubenangu virus, European elk papillomavirus, European swine fever virus, Everglades virus, Eyach virus, Fabavirus, felid herpesvirus 1, feline calicivirus, feline fibrosarcoma virus, feline herpesvirus, feline immunodeficiency virus, feline infectious peritonitis virus, feline leukemia/sarcoma virus, feline leukemia virus, feline panleukopenia virus, feline parvovirus, feline sarcoma virus, feline syncytial virus, Fijivirus, Filovirus, Flanders virus, Flavivirus, foot and mouth disease virus, Fort Morgan virus, Four Corners hantavirus, fowl adenovirus 1, Fowlpox virus, Friend virus, Furovirus, Gammaherpesvirinae, gammaretrovirus, GB virus C (GBV-C; formerly Hepatitis G virus), Geminivirus, German measles virus, Getah virus, gibbon ape leukemia virus, green monkey virus (mullburg), glandular fever virus, goatpox virus, golden shinner virus, Gonometa virus, goose parvovirus, granulosis virus, Gross' virus, ground squirrel hepatitis B virus, group A arbovirus, Guanarito virus, guinea pig cytomegalovirus, guinea pig type C virus, Hantavirus, hard clam reovirus, hare fibroma virus, HCMV (human cytomegalovirus), helper virus, hemadsorption virus 2, hemagglutinating virus of Japan, hemorrhagic fever virus, Hendra virus, Henipaviruses, Hepadnavirus, hepatitis A virus, hepatitis B virus, hepatitis C virus, hepatitis D (delta) virus, hepatitis E virus, hepatitis F virus, hepatitis G virus, hepatitis nonA nonB virus, hepatoencephalomyelitis reovirus 3, Hepatovirus, heron hepatitis B virus, herpes B virus, Herpes simplex virus, herpes simplex virus 1, herpes simplex virus 2, Herpesvirus, Herpes zoster, Herpes virus 6, Herpes virus 7, Herpes virus 8, Herpesvirus ateles, Herpesvirus *hominis*, Herpesvirus saimiri, Herpesvirus suis, Herpesvirus varicellae, Highlands J virus, Hirame rhabdovirus, HIV-1, hog cholera virus, Hordeivirus, Horse Flu, HTLV-1, HTLV-2, human adenovirus 2, human alphaherpesvirus 1, human alphaherpesvirus 2, human alphaherpesvirus 3, human B lymphotropic virus, human betaherpesvirus 5, human coronavirus, Human enterovirus A, Human enterovirus B, Human Flu, human foamy virus, human gammaherpesvirus 4, human gammaherpesvirus 6, human hepatitis A virus, human herpesvirus 1 group, human herpesvirus 2 group, human herpesvirus 3 group, human herpesvirus 4 group, human herpesvirus 6, human herpesvirus 8, human immunodeficiency virus (HIV), human immunodeficiency virus 1, human immunodeficiency virus 2, Human metapneumovirus, human papillomavirus, human T cell leukemia virus, human T cell leukemia virus I, human T cell leukemia virus II, human T cell leukemia virus III, human T cell lymphoma virus I, human T cell lymphoma virus II, human T cell lymphotropic virus type 1, human T cell lymphotropic virus type 2, human T lymphotropic virus I, human T lymphotropic virus II, human T lymphotropic virus III, ichnovirus, Ilarvirus, infantile gastroenteritis virus, infectious bovine rhinotracheitis virus, infectious haematopoietic necrosis virus, infectious pancreatic necrosis virus, influenza virus, influenzavirus A, influenzavirus B, influenzavirus C, influenzavirus D, influenzavirus pr8, insect iridescent virus, insect virus, interfering virus, iridovirus, Isavirus, Japanese B virus, Japanese encephalitis virus, JC virus, Junin virus, Johnson grass mosaic virus, Kaposi's sarcoma-associated herpesvirus, Kemerovo virus, Kilham's rat virus, Klamath virus, Kolongo virus, Korean hemorrhagic fever virus, kumba virus, Kumlinge virus, Kunjin virus, Kyasanur forest disease, Kyzylagach virus, La Crosse virus, lactic dehydrogenase elevating virus, Lagos bat virus, Lambda phage, langat virus, Langur virus, lapine parvovirus, Lassa fever virus, Lassa virus, latent rat virus, LCM virus, Leaky virus, Lentivirus, Leporipoxvirus, leukemia virus, leukovirus, louping ill virus, lumpy skin disease virus, Luteovirus, lymphadenopathy associated virus, Lymphocytic choriomeningitis virus (LCMV), Lymphocryptovirus, lymphocytic choriomeningitis virus, lymphoproliferative virus group, Lyssavirus, Machupo virus, mad itch virus, maize chlorotic dwarf virus, maize rough dwarf virus, mammalian type B oncovirus group, mammalian type B retroviruses, mammalian type C retrovirus group, mammalian type D retroviruses, mammary tumor virus, Mapuera virus, Marafivirus, Marburg virus, Marburg-like virus, Mason Pfizer monkey virus, Mastadenovirus, Mayaro virus, ME virus, Measles virus, Melandrium yellow fleck virus, Menangle virus, Mengo virus, Mengovirus, Merkel cell polyomavirus, Middelburg virus, milkers nodule virus, mink enteritis virus, minute virus of mice, MLV related virus, MM virus, Mokola virus, Molluscipoxvirus, Molluscum contagiosum virus, Moloney murine leukemia virus (M-MuLV), monkey B virus, Monkeypox virus, Mononegavirales, Morbillivirus, Mount Elgon bat virus, mouse cytomegalovirus, mouse encephalomyelitis virus, mouse hepatitis virus, mouse K virus, mouse leukemia virus, mouse mammary tumor virus, mouse minute virus, mouse pneumonia virus, mouse poliomyelitis virus, mouse polyomavirus, mouse sarcoma virus, mousepox virus, Mozambique virus, Mucambo virus, mucosal disease virus, Mumps virus, murid betaherpesvirus 1, murid cytomegalovirus 2, murine cytomegalovirus group, murine encephalomyelitis virus, murine hepatitis virus, murine leukemia virus, murine nodule inducing virus, murine polyomavirus, murine sarcoma virus, Muromegalovirus, Murray Valley encephalitis virus, myxoma virus, Myxovirus, Myxovirus multiforme, Myxovirus parotitidis, Nairobi sheep disease virus, Nairovirus, Nanirnavirus, Nariva virus, Ndumo virus, Necrovirus, Neethling virus, Nelson Bay virus, Nemtick Virus, Nepovirus, neurotropic virus, New World Arenavirus, newborn pneumonitis virus, Newcastle disease virus, Nipah virus, noncytopathogenic virus, Norovirus, Norwalk virus, nuclear polyhedrosis virus (NPV), nipple neck virus, O'nyong'nyong virus, oat sterile dwarf virus, Ockelbo virus, Omsk hemorrhagic fever virus, oncogenic virus, oncogenic viruslike particle, oncornavirus, Orbivirus, Orf virus, Oropouche virus, Orthohepadnavirus, orthomyxovirus, Orthopoxvirus, Orthoreovirus, Orungo, ovine papillomavirus, ovine catarrhal fever virus, owl monkey herpesvirus, Palyam virus, Papillomavirus, Papillomavirus sylvilagi, Papovavirus, Parainfluenza virus human (HPIV), parainfluenza virus type 1 human (HPIV-1), parainfluenza virus type 2 human (HPIV-2), parainfluenza virus type 3 human (HPIV-3), parainfluenza virus type 4 human (HPIV-4), Paramyxovirus, Parapoxvirus, paravaccinia virus, parsnip yellow fleck virus, Parvovirus, Parvovirus B19, pea enation mosaic virus, Pestivirus, Phlebovirus, phocine distemper virus, Phytoreovirus, Picodnavirus, Picornavirus, pig cytomegalovirus, pigeonpox virus, Piry virus, Pixuna virus, plant rhabdovirus group, plant virus, pneumonia virus of mice, Pneumovirus, Poliomyelitis virus, Poliovirus, Polydnavirus, polyhedral virus, Polyoma virus, Polyomavirus, Polyomavirus bovis, Polyomavirus cercopitheci, Polyomavirus *hominis* 2, Polyomavirus maccacae 1, Polyomavirus muris 1, Polyomavirus muris 2, Polyomavirus papionis 1, Polyomavirus papionis 2, Polyomavirus sylvilagi, Pongine herpesvirus 1, porcine epidemic diarrhea virus, porcine hemagglutinating encephalomyelitis virus, porcine parvovirus, porcine transmissible gastroenteritis virus, porcine type C virus, Potato leaf roll virus, Potato mop top virus, Potato virus Y, Potexvirus, Potyvirus, Powassan encephalitis virus, Poxvirus, poxvirus variolae, Prospect Hill virus, provirus, pseudocowpox virus, pseudorabies virus, psittacinepox virus, Puumala virus, Qalyub virus, Quail pea mosaic virus, quailpox virus, Queensland fruitfly virus, Quokkapox virus, rabbit fibroma virus, rabbit kidney vaculolating virus, rabbit papillomavirus, Rabies virus, raccoon parvovirus, raccoonpox virus, radish mosaic virus, Ranikhet virus, rat cytomegalovirus, rat parvovirus, rat virus, Rauscher's virus, recombinant vaccinia virus, recombinant virus, Red Clover Necrotic Mosaic Virus, reovirus, reovirus 1, reovirus 2, reovirus 3, reptilian type C virus, Respiratory syncytial virus, respiratory virus, reticuloendotheliosis virus, Retrovirus, Rhabdovirus, Rhabdovirus carpia, Rhadinovirus, Rhinovirus, Rhizidiovirus, rice dwarf virus, rice gall dwarf virus, rice hoja blanca virus, rice ragged stunt virus, Rift Valley fever virus, Riley's virus, rinderpest virus, RNA tumor virus, RNA virus, Roseolovirus, Ross River virus, Rotavirus, rougeole virus, Rous sarcoma virus, Rubella virus, rubeola virus, Rubivirus, Russian autumn encephalitis virus, S6-14-03 virus, SA 11 simian virus, SA 15, SA2 virus, SA6 virus, SA8 virus, Sabia virus, Sabio virus, Sabo virus, Saboya virus, Sabulodes caberata GV, Sacbrood virus, Saccharomyces cerevisiae virus L-A, Saccharomyces cerevisiae virus La, Saccharomyces cerevisiae virus LBC, Sagiyama virus, Saguaro cactus virus, Saimiriine herpesvirus 1, Saimiriine herpesvirus 2, Sainpaulia leaf necrosis virus, Saint-Abb's Head virus, Saint-Floris virus, Sakhalin virus, Sal Vieja virus, Salanga virus, Salangapox virus, Salehabad virus, salivary gland virus, Salmonid herpesvirus 1, Salmonid herpesvirus 2, Salmonis virus, Sambucus vein clearing virus, Samia cynthia NPV, Samia pryeri NPV, Samia ricini NPV, Sammons' Opuntia virus, SanAngelo virus, San Juan virus, San Miguel sealion virus, San Perlita virus, Sand rat nuclear inclusion agents, Sandfly fever Naples virus, Sandfly fever Sicilian virus, Sandjimba virus, Sango virus, Santa Rosa virus, Santarem virus, Santosai temperate virus, Sapphire II virus, Sapporo-like virus, Saraca virus, Sarracenia purpurea virus, SARS virus, satellite virus, Sathuperi virus, Satsuma dwarf virus, Saturnia pavonia virus, Saturnia pyri NPV, Saumarez Reef virus, Sawgrass virus, Sceliodes cordalis NPV, Schefflera ringspot virus, Sciaphila duplex GV, Scirpophaga incertulas NPV, Sciurid herpesvirus, Sciurid herpesvirus 2, Scoliopteryx libatFix NPV, Scopelodes contracta NPV, Scopelodes venosa NPV, Scopula subpunctaria NPV, Scotogramma trifolii GV, Scotogramma trifolu NPV, Scrophularia mottle virus, SDAV (sialodacryoadenitis virus), sealpox virus, Selenephera lunigera NPV, Selepa celtis GV, Seletar virus, Selidosema suavis NPV, Semidonta biloba NPV, Semiothisa sexmaculata GV, Semliki Forest Virus, Sena Madureira virus, Sendai virus, SENV-D, SENV-H, Seoul virus, Sepik virus, Serra do Navio virus, Serrano golden mosaic virus, Sesame yellow mosaic virus, Sesamia calamistis NPV, Sesamia cretica GV, Sesamia inferens NPV, Sesamia nonagrioides GV, Setora nitens virus, Shallot latent virus, Shamonda virus, Shark River virus, Sheep associated malignant catarrhal fever, Sheep papillomavirus, Sheep pulmonary adenomatosis associated herpesvirus, sheeppox virus, Shiant Islands virus, Shokwe virus, Shope fibroma virus, Shope papilloma virus, Shuni virus, Siamese cobra herpesvirus, Sibine fusca densovirus, Sida golden mosaic virus (SiGMV), Sida golden yellow vein virus (SiGYVV), Sigma virus, Sikte water-borne virus, Silverwater virus, Simbu virus, Simian adenoviruses 1 to 27, Simian agent virus 12, Simian enterovirus 1 to 18, simian foamy virus, Simian hemorrhagic fever virus, simian hepatitis A virus, simian human immunodeficiency virus, simian immunodeficiency virus, simian parainfluenza virus, Simian rotavirus SA11, Simian sarcoma virus, simian T cell lymphotrophic virus, Simian type D virus 1, Simian vancella herpesvirus, simian virus, simian virus 40, Simplexvirus, Simulium vittatum densovirus, Sin Nombre virus, Sindbis virus, Sintlem's onion latent virus, Sixgun city virus, Skunkpox virus, Smallpox virus, Smelt reovirus, Smerinthus ocellata NPV, Smithiantha virus, Snakehead rhabdovirus, Snowshoe hare virus, Snyder-Theilen feline sarcoma virus, Sobemovirus, Sofyn virus, Soil-borne wheat mosaic virus, Sokoluk virus, Solanum apical leaf curl virus, Solanum nodiflorum mottle virus, Solanurn yellows virus, Soldado virus, Somerville virus 4, Sonchus mottle virus, Sonchus virus, Sonchus yellow net virus, Sorghum chlorotic spot virus, Sorghum mosaic virus, Sorghum virus, Sororoca virus, Soursop yellow blotch virus, SouthAfrican passiflora virus, South American hemorrhagic fever viruses, SouthAfrican passiflora virus, South River virus, Southern bean mosaic virus, Southern potato latent virus, Sowbane mosaic virus, Sowthistle yellow vein virus, Soybean chlorotic mottle virus, Soybean crinkle leaf virus, Soybean dwarf virus, Soybean mosaic virus, SPAr-2317 virus, Sparganothis pettitana NPV, sparrowpox virus, Spartina mottle virus, Spectacled caimanpox virus, SPH 114202 virus, Sphenicid herpesvirus 1, Sphinx ligustri NPV, Spider monkey herpesvirus, Spilarctia subcarnea NPV, Spilonota ocellana NPV, Spilosoma lubricipeda NPV, Spinach latent virus, Spinach temperate virus, Spiroplasma phage 1, Spiroplasma phage 4, Spiroplasma phage aa, Spiroplasma phage C1/TS2, Spodoptera exempta cypovirus, Spodoptera exigua virus, Spodoptera frugiperda virus, Spodoptera latifascia virus, Spodoptera littoralis, Spodoptera mauritia virus, Spodoptera ornithogalli virus, Spondweni virus, spring beauty latent virus, Spring viremia of carp virus, Spumavirus (SFV, HFV), Squash leaf curl virus, squash mosaic virus, squirrel fibroma virus, Squirrel monkey herpesvirus, squirrel monkey retrovirus, SR-11 virus, Sri Lankan passionfruit mottle virus, Sripur virus, SSV 1 virus group, StAbbs Head virus, St. Louis encephalitis virus, *Staphylococcus* phage 107, *Staphylococcus* phage 187, *Staphylococcus* phage 2848A, *Staphylococcus* phage 3A, *Staphylococcus* phage 44A HJD, *Staphylococcus* phage 77, *Staphylococcus* phage B11-M15, *Staphylococcus* phage Twort, Starlingpox virus, Statice virus Y, P, STLV (simian T lymphotropic virus) type I, STLV (simian T lymphotropic virus) type II, STLV (simian T lymphotropic virus) type Ill, stomatitis papulosa virus, Stratford virus, Strawberry crinkle virus, Strawberry latent ringspot virus, Strawberry mild yellow edge virus, Strawberry vein banding virus, *Streptococcus* phage 182, *Streptococcus* phage 2BV, *Streptococcus* phage A25, *Streptococcus* phage 24, *Streptococcus* phage PE1, *Streptococcus* phage VD13, *Streptococcus* phage fD8, *Streptococcus* phage CP-1, *Streptococcus* phage Cvir, *Streptococcus* phage H39, Strigid herpesvirus 1, Striped bass reovirus, Striped Jack nervous, necrosis virus, Stump-tailed macaque virus, submaxillary virus, Subterranean clover mottle virus, Subterranean clover mottle virus satellite, Subterranean clover red leaf virus, Subterranean clover stunt virus, Sugarcane bacilliform virus, Sugarcane mild mosaic virus, Sugarcane mosaic virus, Sugarcane streak virus, suid alphaherpesvirus 1, suid herpesvirus 2, Suipoxvirus, Sulfolobus virus 1, Sunday Canyon virus, Sunflower crinkle virus, Sunflower mosaic virus, Sunflower rugose mosaic virus, Sunflower yellow blotch virus, Sunflower yellow ringspot virus, Sun-hemp mosaic virus, swamp fever virus, Sweet clover necrotic mosaic virus, Sweet potato A virus, Sweet potato chlorotic leafspot virus, Sweet potato feathery mottle virus, Sweet potato internal cork virus, Sweet potato latent virus, Sweet potato mild mottle virus, Sweet potato russet crack virus, Sweet potato vein mosaic virus, Sweet potato yellow dwarf virus, Sweetwater Branch virus, Swine cytomegalovirus, Swine Flu, Swine infertility and respiratory syndrome virus, swinepox virus, Swiss mouse leukemia virus, Sword bean distortion mosaic virus, Synaxis jubararia NPV, Synaxis pallulata NPV, Synetaeris tenuifemur virus, Syngrapha selecta NPV, T4 phage, T7 phage, TAC virus, Tacaiuma virus, Tacaribe complex virus, Tacaribe virus, Tadpole edema virus LT 1-4, Taggert virus, Tahyna virus, Tai virus, Taiassui virus, Tamana bat virus, Tamarillo mosaic virus, Tamdy virus, Tamiami virus, Tanapox virus, Tanga virus, Tanjong Rabok virus, Taro bacilliform virus, Badnavirus Tataguine virus, Taterapox virus, Taterapox virus, Teasel mosaic virus, Tehran virus, Telfairia mosaic virus, Telok Forest virus, Tembe virus, Tembusu virus, Tench reovirus, Tensaw virus, Tenvivirus, Tephrosia symptomless virus, Termeil virus, Tete virus, Tetralopha scortealis NPV, Tetropium cinnamoptemm NPV, Texas pepper virus, Thailand virus, Thaumetopoea pityocampa virus, Theiler's encephalomyelitis virus, Theiler's virus, Theophila mandarina NPV, Theretra japonica NPV, Thermoproteus virus 1, Thermoproteus virus 2, Thermoproteus virus 3, Thermoproteus virus 4, Thiafora virus, Thimiri virus, Thistle mottle virus, Thogoto virus, Thormodseyjarklettur virus, Thosea asigna virus, Thosea baibarana NPV, Thosea sinensis GV, Thottapalayam virus, Thylidolpteryx ephemeraeformis NPV, Thymelicus lineola NPV, Tibrogargan virus, Ticera castanea NPV, Tick borne encephalitis virus (TBEV)—European and Far Eastern subtypes, Tillamook virus, Tilligerry virus, Timbo virus, Tilmboteua virus, Tilmaroo virus, Tindholmur virus, Tinea pellionella NPV, Tineola hisselliella NPV, Tinpula paludosa NPV, Tinracola plagiata NPV, Tioman virus, Tlacotalpan virus, Tobacco bushy top virus, Tobacco etch virus, Tobacco leaf curl virus, Tobacco mild green mosaic virus, tobacco mosaic virus, Tobacco mosaic virus satellite, Tobacco mottle virus, Tobacco necrosis virus, Tobacco necrosis virus satellite, Tobacco necrosis virus small satellite, Tobacco necrotic dwarf virus, tobacco rattle virus, Tobacco ringspot virus, Tobacco streak virus, Tobacco stunt virus, Tobacco vein banding mosaic virus, Tobacco vein distorting virus Tobacco vein mottling virus, Tobacco wilt virus, Tobacco yellow dwarf virus, Tobacco yellow net virus, Tobacco yellow vein virus, Tobamovirus Tobravirus, Togavirus, Tomato apical stunt viroid, Tomato aspermy virus, Tomato black ring virus, Tomato black ring virus satellite, Tomato bunchy top viroid, tomato bushy stunt virus, Tomato bushy stunt virus satellite, Tomato golden mosaic virus, Tomato leaf crumple virus, Tomato leaf curl virus, Tomato leafroll virus, Tomato mosaic virus, Tomato mottle virus, Tomato pale chlorosis virus, Tomato planta macho viroid, Tomato pseudo-curly top virus, Tomato ringspot virus, Tomato spotted wilt virus, Tomato top necrosis virus, Tomato vein yellowing virus, Tomato yellow dwarf virus, Tomato yellow leaf curl virus, Tomato yellow mosaic virus, Tomato yellow top virus, Tombusvirus, Tongan vanilla virus, Torovirus, Torque teno virus, Tortrix loeflingiana NPV, Tortrix viridana NPV, Toscana virus, Tospovirus, Toxorhynchites brevipalpis NPV, Trabala vishnou NPV, Tradescantia/Zebrina virus, Trager duck spleen necrosis virus, Tranosema sp. Virus, transforming virus, Tree shrew adenovirus 1, Tree shrew herpesvims, Triatoma virus, Tribec virus, Trichiocampus irregularis NPV, Trichiocampus viminalis NPV, Trichomonas vaginalis virus, Trichoplusia ni cypovirus 5, Trichoplusia ni granulovirus, Trichoplusia ni MNPV, Trichoplusia ni Single SNPV, Trichoplusia ni virus, Trichosanthes mottle virus, Triticum aestivum chlorotic spot virus, Trivittatus virus, Trombetas virus, Tropaeolum virus 1, Tropaeolum virus 2, Trubanarnan virus, Tsuruse virus, Tucunduba virus, Tulare apple mosaic virus, Tulip band breaking virus, Tulip breaking virus, Tulip chlorotic blotch virus, Tulip top breaking virus, Tulip virus X, tumor virus, Tupaia virus, Tupaiid herpesvirus 1, Turbot herpesvirus, Turbot reovirus, Turkey adenoviruses 1 to 3, Turkey coronavirus, Turkey herpesvirus 1, turkey rhinotracheitis virus, turkeypox virus, Turlock virus, Turnip crinkle virus, Turnip crinkle virus satellite, Turnip mild yellows virus, Turnip mosaic virus, Turnip rosette virus, turnip yellow mosaic virus, Turuna virus, Tymovirus, Tyuleniy virus, type C retroviruses, type D oncovirus, type D retrovirus group, Uasin Gishu disease virus, Uganda S virus, Ugymyia sericariae NPV, ulcerative disease rhabdovirus, Ullucus mild mottle virus, Ullucus mosaic virus, Ullucus virus C, Umatilla virus, Umbre virus, Una virus, Upolu virus, UR2 sarcoma virus, Uranotaenia sapphirina NPV, Urbanus proteus NPV, Urucuri virus, Ustilago maydis virus 1, Ustilago maydis virus 4, Ustilago maydis virus 6, Usutu virus, Utinga virus, Utive virus, Uukuniemi virus group, Vaccinia virus, Vaeroy virus, Vallota mosaic virus, Vanessa atalanta NPV, Vanessa cardui NPV, Vanessa prorsa NPV, Vanilla mosaic virus, Vanilla necrosis virus, Varicella zoster virus, Varicellovirus, Varicola virus, variola major virus, variola virus, Vasin Gishu disease virus, Vellore virus, Velvet tobacco mottle virus, Velvet tobacco mottle virus satellite, Venezuelan equine encephalitis virus, Venezuelan equine encephalomyelitis virus, Venezuelan hemorrhagic fever virus, Vesicular stomatitis virus, Vesiculovirus, *Vibrio* phage 06N-22P, *Vibrio* phage 06N-58P, *Vibrio* phage 4996, *Vibrio* phage a3a, *Vibrio* phage I, *Vibrio* phage II, *Vibrio* phage m, *Vibrio* phage IV, *Vibrio* phage kappa, *Vibrio* phage nt-1, *Vibrio* phage OXN-52P, *Vibrio* phage OXN-IOOP, *Vibrio* phage v6, *Vibrio* phage Vfl2, *Vibrio* phage Vf33, *Vibrio* phage VP1, *Vibrio* phage VP11, *Vibrio* phage VP3, *Vibrio* phage VP5, *Vibrio* phage X29, Vicia cryptic virus, Vigna sinensis mosaic virus, Vilyuisk virus, Vinces virus, Viola mottle virus, viper retrovirus, viral haemorrhagic septicemia virus, virus-like particle, Visna Maedi virus, Visna virus, Voandzeia mosaic virus, Voandzeia necrotic mosaic virus, volepox virus, Wad Medani virus, Wallal virus, Walleye epidermal hyperplasia, Walrus calicivirus, Wanowrie virus, Warrego virus, Watermelon chlorotic stunt virus, Watermelon curly mottle virus, Watermelon mosaic virus 1, Watermelon mosaic virus 2, Weddel water-borne virus, Weldona virus, Wesselsbron virus, West Nile virus, western equine encephalitis virus, western equine encephalomyelitis virus, Wexford virus, Whataroa virus, Wheat American striate mosaic virus, Wheat chlorotic streak virus, Wheat dwarf virus, Wheat rosette stunt virus, Wheat streak mosaic virus, Wheat yellow leaf virus, Wheat yellow mosaic virus, White bryony virus, White clover cryptic virus 1, White clover cryptic virus 2, White clover cryptic virus 3, White clover mosaic virus, White lupinrnosaic virus, Wild cucumber mosaic virus, Wild potato mosaic virus, Wildbeest herpesvirus, Wineberry latent virus, Winter wheat mosaic virus, Winter wheat Russian mosaic virus, Wiseana cervinata virus, Wiseana signata virus, Wiseana umbraculata virus, Wissadula mosaic virus, Wisteria vein mosaic virus, Witwatersrand virus, Wongal virus, Wongorr virus, Winter Vomiting Virus, woodchuck hepatitis B virus, Woodchuck herpesvirus marmota 1, woolly monkey sarcoma virus, wound tumor virus, WRSV virus, WVU virus 2937, WW virus 71 to 212, Wyeomyia smithii NPV, Wyeomyia virus, Xanthomonas phage Cf, Xanthomonas phage Cflt, Xanthomonas phage RR66, Xanthomonas phage Xf, Xanthomonas phage Xf2, Xanthomonas phage XP5, Xenopus virus T21, Xiburema virus, Xingu virus, Xylena curvimacula NPV, Y73 sarcoma virus, Yaba monkey tumor virus, Yaba-1 virus, Yaba-7 virus, Yacaaba virus, Yam mosaic virus, Yaounde virus, Yaquina Head virus, Yatapoxvirus, Yellow fever virus, Yogue virus, Yokapox virus, Yokase virus, Yponomeuta cognatella NPV, Yponomeuta evonymella NPV, Yponomeuta malinellus NPV, Yponomeuta padella NPV, Yucca baciliform virus, Yug Bogdanovac virus, Zaliv Terpeniya virus, Zea mays virus, Zegla virus, Zeiraphera diniana virus, Zeiraphera pseudotsugana NPV, Zika virus, Zirqa virus, Zoysia mosaic virus, Zucchini yellow fleck virus, Zucchini yellow mosaic virus and Zygocactus virus.

1341. The method for vaccination according to item 1172, wherein the vaccination is for treatment of one or more diseases caused by a bacterial infection.

1342. The method for vaccination according to item 1341, wherein bacterial infection is caused by one or more bacteria selected from the group consisting of Acidobacteria, Actinobacteria, Aquificae, Bacteroidetes, Chlamydiae, Chlorobi, Chloroflexi, Chrysiogenetes, Cyanobacteria, Deferribacteres, Deinococcus-Thermus, Dictyoglomi, Fibrobacteres, Firmicutes, Fusobacteria, Gemmatimonadetes, Nitrospirae, Planctomycetes, Proteobacteria, Spirochaetes, Thermodesulfobacteria, Thermomicrobia, Thermotogae and Verrucomicrobia bacterial phyla; these may be Gram negative (Spirochetal, Chlamydiae, Proteobacteria α, β, γ) and Gram positive bacteria (Firmicutes, Actinobacteria (*Mycobacterium*, Actinomycetales)).

1343. The method for vaccination according to item 1341, wherein bacterial infection is caused by one or more bacteria selected from the group consisting of *Acetobacter aurantius, Acinetobacter* species, *Acinetobacter baumannii, Acinetobacter calcoaceticus, Acinetobacter johnsonii, Acinetobacter junii, Acinetobacter lwoffii, Acinetobacter radioresistens, Acinetobacter septicus, Acinetobacter schindleri, Acinetobacter ursingii; Actinomyces* species: *Actinomyces bovis, Actinomyces bowdenii, Actinomyces canis, Actinomyces cardiffensis, Actinomyces catuli, Actinomyces coleocanis, Actinomyces dentalis, Actinomyces denticolens, Actinomyces europaeus, Actinomyces funkei, Actinomyces georgiae, Actinomyces gerencseriae, Actinomyces graevenitzii, Actinomyces hongkongensis, Actinomyces hordeovulneris, Actinomyces howellii, Actinomyces humiferus, Actinomyces hyovaginalis, Actinomyces israelii, Actinomyces marimammalium, Actinomyces meyeri, Actinomyces naeslundii, Actinomyces nasicola, Actinomyces neuii, Actinomyces odontolyticus, Actinomyces oricola, Actinomyces radicidentis, Actinomyces radingae, Actinomyces slackii, Actinomyces streptomycini, Actinomyces suimastitidis, Actinomyces suis, Actinomyces turicensis, Actinomyces urogenitalis, Actinomyces vaccimaxillae, Actinomyces viscosus; Actinobacillus* species: *Actinobacillus actinomycetemcomitans, Actinobacillus arthritidis, Actinobacillus capsulatus, Actinobacillus delphinicola, Actinobacillus equuli, Actinobacillus hominis, Actinobacillus indolicus, Actinobacillus lignieresii, Actinobacillus minor, Actinobacillus muris, Actinobacillus pleuropneumoniae, Actinobacillus porcinus, Actinobacillus rossii, Actinobacillus scotiae, Actinobacillus seminis, Actinobacillus succinogenes, Actinobacillus suis, Actinobacillus ureae; Aeromonas* species: *Aeromonas allosaccharophila, Aeromonas bestiarum, Aeromonas bivalvium, Aeromonas encheleia, Aeromonas enteropelogenes, Aeromonas euchrenophila, Aeromonas hydrophila, Aeromonas ichthiosmia, Aeromonas jandaei, Aeromonas media, Aeromonas molluscorum, Aeromonas popoffii, Aeromonas punctata, Aeromonas salmonicida, Aeromonas schubertii, Aeromonas sharmana, Aeromonas simiae, Aeromonas sobria, Aeromonas veronii; Afipia felis, Agrobacterium* species, *Agrobacterium radiobacter, Agrobacterium rhizogenes, Agrobacterium rubi, Agrobacterium tumefaciens; Agromonas* species, *Alcaligenes* species: *Alcaligenes aquatilis, Alcaligenes eutrophus, Alcaligenes faecalis, Alcaligenes latus, Alcaligenes xylosoxidans; Alishewanella* species, *Alterococcus* species, *Anaplasma phagocytophilum, Anaplasma marginale, Aquamonas* species, *Arcanobacterium haemolyticum, Aranicola* species, *Arsenophonus* species, *Azotivirga* species, *Azotobacter vinelandii, Azotobacter chroococcum,* Bacillary dysentery (Shigellosis), *Bacillus* species: *Bacillus abortus* (*Brucella melitensis* biovar *abortus*), *Bacillus anthracis* (Anthrax), *Bacillus brevis, Bacillus cereus, Bacillus coagulans, Bacillus fusiformis, Bacillus globigii, Bacillus licheniformis, Bacillus megaterium, Bacillus mycoides, Bacillus natto, Bacillus stearothermophilus, Bacillus subtilis, Bacillus sphaericus, Bacillus thuringiensis; Bacteroides* species: *Bacteroides forsythus* (Tannerella forsythensis), *Bacteroides acidifaciens, Bacteroides distasonis* (reclassified as Parabacteroides distasonis), *Bacteroides gingivalis, Bacteroides gracilis, Bacteroides fragilis, Bacteroides oris, Bacteroides ovatus, Bacteroides putredinis, Bacteroides pyogenes, Bacteroides stercoris, Bacteroides suis, Bacteroides tectus, Bacteroides thetaiotaomicron, Bacteroides vulgatus; Bartonella* species: *Bartonella alsatica, Bartonella bacilliformis, Bartonella birtlesii, Bartonella bovis, Bartonella capreoli, Bartonella clarridgeiae, Bartonella doshiae, Bartonella elizabethae, Bartonella grahamii, Bartonella henselae* (cat scratch fever), *Bartonella koehlerae, Bartonella muris, Bartonella peromysci, Bartonella quintana, Bartonella rochalimae, Bartonella schoenbuchii, Bartonella talpae, Bartonella taylorii, Bartonella tribocorum, Bartonella vinsonii* spp. *Arupensis, Bartonella vinsonii* spp. *Berkhoffii, Bartonella vinsonii* spp. *Vinsonii, Bartonella washoensis;* BCG (Bacille Calmette-Guerin), *Bergeyella zoohelcum* (Weeksella zoohelcum), *Bifidobacterium bifidum, Blastobacter* species, *Blochmannia* species, *Bordetella* species: '*Bordetella ansorpii*', *Bordetella avium, Bordetella bronchiseptica, Bordetella hinzii, Bordetella holmesii, Bordetella parapertussis, Bordetella pertussis* (Whooping cough), *Bordetella petrii, Bordetella trematum; Borrelia* species: *Borrelia anserine, Borrelia barbouri, Borrelia burgdorferi* such as *burgdorferi* B31, *Borrelia afzelii* such as *Borrelia afzelii* ACA-1, *Borrelia afzelii* K78 and/or *Borrelia afzelii* PKo, *Borrelia andersonii, Borrelia anserine, Borrelia bissettii, Borrelia burgdorferi* 118a, *Borrelia burgdorferi* 156a, *Borrelia burgdorferi* 29805, *Borrelia burgdorferi* 64b, *Borrelia burgdorferi* 72a, *Borrelia burgdorferi* 80a, *Borrelia burgdorferi* 94a, *Borrelia burgdorferi* B31, *Borrelia burgdorferi* Bol26, *Borrelia burgdorferi* CA-11.2a, *Borrelia burgdorferi* W191-23, *Borrelia burgdorferi* ZS7, *Borrelia californiensis, Borrelia garini* such as garini PBi, garini PBr, *Borrelia* genomosp. 1, *Borrelia* genomosp. 2, *Borrelia japonica, Borrelia lusitaniae, Borrelia spielmanii, Borrelia spielmanii* A14S, *Borrelia tanukii, Borrelia turdi, Borrelia valaisiana, Borrelia valaisiana* VS116, Candidatus *Borrelia texasensis, Borrelia* sp. AA4Pool, *Borrelia* sp. AI-1, *Borrelia* sp. B31, *Borrelia* sp. BC-1, *Borrelia* sp. CA1133, *Borrelia* sp. CA1176, *Borrelia* sp. CA128, *Borrelia* sp. CA13, *Borrelia* sp. CA134, *Borrelia* sp. CA142, *Borrelia* sp. CA20, *Borrelia* sp. CA22, *Borrelia* sp. CA27, *Borrelia* sp. CA28, *Borrelia* sp. CA29, *Borrelia* sp. CA31, *Borrelia* sp. CA33, *Borrelia* sp. CA370, *Borrelia* sp. CA372, *Borrelia* sp. CA378, *Borrelia* sp. CA388, *Borrelia* sp. CA393, *Borrelia* sp. CA394, *Borrelia* sp. CA395, *Borrelia* sp. CA399, *Borrelia* sp. CA400, *Borrelia* sp. CA401, *Borrelia* sp. CA402, *Borrelia* sp. CA404, *Borrelia* sp. CA411, *Borrelia* sp. CA426, *Borrelia* sp. CA443, *Borrelia* sp. CA446, *Borrelia* sp. CA448, *Borrelia* sp. CA462, *Borrelia* sp. CA468, *Borrelia* sp. CA502, *Borrelia* sp. CA504, *Borrelia* sp. CA507, *Borrelia* sp. CA547, *Borrelia* sp. CA552, *Borrelia* sp. CA8, *Borrelia* sp. D22, *Borrelia* sp. D35, *Borrelia* sp. FD-1, *Borrelia* sp. FL18, *Borrelia* sp. FL27, *Borrelia* sp. FL35, *Borrelia* sp. FL42, *Borrelia* sp. HN6, *Borrelia* sp. HN7, *Borrelia* sp. HN8, *Borrelia* sp. HNM13, *Borrelia* sp. HNM14, *Borrelia* sp. HNM19, *Borrelia* sp. IA1, *Borrelia* sp. Ir-3519, *Borrelia* sp. Ir-4721, *Borrelia* sp. Ir-4812, *Borrelia* sp. Ir-5215, *Borrelia* sp. LV5, *Borrelia* sp. MI-2, *Borrelia* sp. MI-5, *Borrelia* sp. MI-6, *Borrelia* sp. MI-8, *Borrelia* sp. MI-9, *Borrelia* sp. MOD-1, *Borrelia* sp. MOD-5, *Borrelia* sp. MOK-3a, *Borrelia* sp. MOS-1b, *Borrelia* sp. NE49, *Borrelia* sp. NE581,

*Borrelia* sp. PHaP, *Borrelia* sp. PSigII, *Borrelia* sp. SCGT-10, *Borrelia* sp. SCGT-8a, *Borrelia* sp. SCI-2, *Borrelia* sp. SCW-30h, *Borrelia* sp. SI-1, *Borrelia* sp. SI-10, *Borrelia* sp. SM-1, *Borrelia* sp. SV1, *Borrelia* sp. W97F51, *Borrelia* sp. Z41293, *Borrelia* sp. Z41493, *Borrelia coriaceae, Borrelia crocidurae, Borrelia duttonii, Borrelia duttonii* Ly, *Borrelia hermsii, Borrelia hermsii* DAH, *Borrelia hispanica, Borrelia lonestari, Borrelia miyamotoi, Borrelia parkeri, Borrelia persica, Borrelia recurrentis, Borrelia recurrentis* A1, *Borrelia sinica, Borrelia theileri, Borrelia turcica, Borrelia turicatae, Borrelia turicatae* 91E135, *Borrelia* sp., *Borrelia* sp. 'Lake Gaillard', *Borrelia* sp. 000133, *Borrelia* sp. 010298, *Borrelia* sp. 10MT, *Borrelia* sp. 5145, *Borrelia* sp. 57Nsk, *Borrelia* sp. 5MT, *Borrelia* sp. 6T04-2, *Borrelia* sp. BR, *Borrelia* sp. BR 2007, *Borrelia* sp. C5-N52, *Borrelia* sp. CB-A1, *Borrelia* sp. CB-A11, *Borrelia* sp. CB-A3, *Borrelia* sp. EFL-S0100110, *Borrelia* sp. IK/23, *Borrelia* sp. IM/16, *Borrelia* sp. IM/19, *Borrelia* sp. KR1, *Borrelia* sp. KR3, *Borrelia* sp. LB-2001, *Borrelia* sp. LB-M56, *Borrelia* sp. LB-W100, *Borrelia* sp. MK-N61, *Borrelia* sp. NR-N8, *Borrelia* sp. OkME1, *Borrelia* sp. PAnz, *Borrelia* sp. PJes, *Borrelia* sp. PMai, *Borrelia* sp. PMew, *Borrelia* sp. R57, *Borrelia* sp. strain Spain, *Borrelia* sp. TA1, *Borrelia* sp. TM, *Borrelia* sp. TM1 and *Borrelia* sp. TM2; *Bosea* species, *Bradyrhizobium* species, *Brenneria* species, *Brucella* species: *Brucella abortus, Brucella canis, Brucella melitensis, Brucella neotomae, Brucella ovis, Brucella suis, Brucella pinnipediae*; *Buchnera* species, *Budvicia* species, *Burkholderia* species: *Burkholderia cepacia (Pseudomonas cepacia), Burkholderia mallei (Pseudomonas mallei/Actinobacillus mallei), Burkholderia pseudomallei (Pseudomonas pseudomallei)*; *Buttiauxella* species, *Calymmatobacterium granulomatis, Campylobacter* species: *Campylobacter coli, Campylobacter concisus, Campylobacter curvus, Campylobacter fetus, Campylobacter gracilis, Campylobacter helveticus, Campylobacter hominis, Campylobacter hyointestinalis, Campylobacter insulaenigrae, Campylobacter jejuni, Campylobacter lanienae, Campylobacter lari, Campylobacter mucosalis, Campylobacter rectus, Campylobacter showae, Campylobacter sputorum, Campylobacter upsaliensis*; *Capnocytophaga canimorsus* (Dysgonic fermenter type 2), *Corynebacterium* species, *Cardiobacterium hominis, Cedecea* species, *Chlamydia* species: *Chlamydia trachomatis* (Lymphogranuloma venereum), *Chlamydia muridarum, Chlamydia suis*; *Chlamydophila* species: *Chlamydophila pneumoniae, Chlamydophila psittaci* (Psittacosis), *Chlamydophila pecorum, Chlamydophila abortus, Chlamydophila felis, Chlamydophila caviae*; *Citrobacter* species: *Citrobacter amalonaticus, Citrobacter braakii, Citrobacter farmeri, Citrobacter freundii, Citrobacter gillenii, Citrobacter intermedius, Citrobacter koseri* aka *Citrobacter diversus, Citrobacter murliniae, Citrobacter rodentium, Citrobacter sedlakii, Citrobacter werkmanii, Citrobacter youngae*; *Clostridium* species: *Clostridium botulinum, Clostridium difficile, Clostridium novyi, Clostridium septicum, Clostridium tetani* (Tetanus), *Clostridium welchii* (*Clostridium perfringens*); *Corynebacterium* species: *Corynebacterium diphtheriae* (Diphtheria), *Corynebacterium amycolatum, Corynebacterium aquaticum, Corynebacterium bovis, Corynebacterium equi, Corynebacterium flavescens, Corynebacterium glutamicum, Corynebacterium haemolyticum, Corynebacterium jeikeiun* (corynebacteria of group JK), *Corynebacterium minutissimum* (Erythrasma), *Corynebacterium parvum* (also called *Propionibacterium acnes*), *Corynebacterium pseudodiptheriticum* (also called *Corynebacterium hofmannii*), *Corynebacterium pseudotuberculosis* (also called *Corynebacterium ovis*), *Corynebacterium pyogenes, Corynebacterium urealyticum* (corynebacteria of group D2), *Corynebacterium renale, Corynebacterium striatum, Corynebacterium tenuis* (Trichomycosis palmellina, Trichomycosis axillaris), *Corynebacterium ulcerans, Corynebacterium xerosis*; *Coxiella burnetii* (Q fever), *Cronobacter* species: *Cronobacter sakazakii, Cronobacter malonaticus, Cronobacter turicensis, Cronobacter muytjensii, Cronobacter dublinensis*; *Delftia acidovorans* (*Comamonas acidovorans*), *Dickeya* species, *Edwardsiella* species, *Eikenella corrodens, Enterobacter* species: *Enterobacter aerogenes, Enterobacter cloacae, Enterobacter sakazakii*; *Enterococcus* species: *Enterococcus avium, Enterococcus durans, Enterococcus faecalis* (*Streptococcus faecalis/Streptococcus* Group D), *Enterococcus faecium, Enterococcus solitarius, Enterococcus galllinarum, Enterococcus maloratus*; *Ehrlichia chaffeensis, Erysipelothrix rhusiopathiae, Erwinia* species, *Escherichia* species: *Escherichia adecarboxylata, Escherichia albertii, Escherichia blattae, Escherichia coli, Escherichia fergusonii, Escherichia hermannii, Escherichia vulneris*; *Ewingella* species, *Flavobacterium* species: *Flavobacterium aquatile, Flavobacterium branchiophilum, Flavobacterium columnare, Flavobacterium flevense, Flavobacterium gondwanense, Flavobacterium hydatis, Flavobacterium johnsoniae, Flavobacterium pectinovorum, Flavobacterium psychrophilum, Flavobacterium saccharophilum, Flavobacterium salegens, Flavobacterium scophthalmum, Flavobacterium succinans*; *Francisella tularensis* (Tularaemia), *Francisella novicida, Francisella philomiragia, Fusobacterium* species: *Fusobacterium necrophorum* (Lemierre syndrome/Sphaerophorus necrophorus), *Fusobacterium nucleatum, Fusobacterium polymorphum, Fusobacterium novum, Fusobacterium mortiferum, Fusobacterium varium*; *Gardnerella vaginalis, Gemella haemolysans, Gemella morbillorum* (*Streptococcus morbillorum*), *Grimontella* species, *Haemophilus* species: *Haemophilus aegyptius* (Koch-Weeks bacillus), *Haemophilus aphrophilus, Haemophilus avium, Haemophilus ducreyi* (Chancroid), *Haemophilus felis, Haemophilus haemolyticus, Haemophilus influenzae* (Pfeiffer bacillus), *Haemophilus paracuniculus, Haemophilus parahaemolyticus, Haemophilus parainfluenzae, Haemophilus paraphrophilus* (Aggregatibacter aphrophilus), *Haemophilus pertussis, Haemophilus pittmaniae, Haemophilus somnus, Haemophilus vaginalis*; *Hafnia* species, *Hafnia alvei, Helicobacter* species: *Helicobacter acinonychis, Helicobacter anseris, Helicobacter aurati, Helicobacter bilis, Helicobacter bizzozeronii, Helicobacter brantae, Helicobacter Canadensis, Helicobacter canis, Helicobacter cholecystus, Helicobacter cinaedi, Helicobacter cynogastricus, Helicobacter felis, Helicobacter fennelliae, Helicobacter ganmani, Helicobacter heilmannii* (Gastrospirillum hominis), *Helicobacter hepaticus, Helicobacter mesocricetorum, Helicobacter marmotae, Helicobacter muridarum, Helicobacter mustelae, Helicobacter pametensis, Helicobacter pullorum, Helicobacter pylori* (stomach ulcer), *Helicobacter rappini, Helicobacter rodentium, Helicobacter salomonis, Helicobacter trogontum, Helicobacter typhlonius, Helicobacter winghamensis*; Human granulocytic ehrlichiosis (*Anaplasma phagocytophilum/Ehrlichia* phagocytophila), Human monocytotropic ehrlichiosis (Monocytic ehrlichiosis/*Ehrlichia chaffeensis*), *Klebsiella* species: *Klebsiella granulomatis* (*Calymmatobacterium granulomatis*), *Klebsiella mobilis, Klebsiella ornithinolytica, Klebsiella oxytoca, Klebsiella ozaenae, Klebsiella planticola, Klebsiella pneumoniae, Klebsiella rhinoscleromatis, Klebsiella singaporensis, Klebsiella terrigena, Klebsiella trevisanii, Klebsiella variicola*;

*Kingella kingae, Kluyvera* species, *Lactobacillus* species: *Lactobacillus acetotolerans, Lactobacillus acidifarinae, Lactobacillus acidipiscis, Lactobacillus acidophilus* (Doderlein *bacillus*), *Lactobacillus agilis, Lactobacillus algidus, Lactobacillus alimentarius, Lactobacillus amylolyticus, Lactobacillus amylophilus, Lactobacillus amylotrophicus, Lactobacillus amylovorus, Lactobacillus animalis, Lactobacillus antri, Lactobacillus apodemi, Lactobacillus aviarius, Lactobacillus bifermentans, Lactobacillus brevis, Lactobacillus buchneri, Lactobacillus camelliae, Lactobacillus casei, Lactobacillus catenaformis, Lactobacillus ceti, Lactobacillus coleohominis, Lactobacillus collinoides, Lactobacillus composti, Lactobacillus concavus, Lactobacillus coryniformis, Lactobacillus crispatus, Lactobacillus crustorum, Lactobacillus curvatus, Lactobacillus delbrueckii, Lactobacillus delbrueckii* subsp. *Bulgaricus, Lactobacillus delbrueckii* subsp. *Lactis, Lactobacillus diolivorans, Lactobacillus equi, Lactobacillus equigenerosi, Lactobacillus farraginis, Lactobacillus farciminis, Lactobacillus fermentum, Lactobacillus fornicalis, Lactobacillus fructivorans, Lactobacillus frumenti, Lactobacillus fuchuensis, Lactobacillus gallinarum, Lactobacillus gasseri, Lactobacillus gastricus, Lactobacillus ghanensis, Lactobacillus graminis, Lactobacillus hammesii, Lactobacillus hamsteri, Lactobacillus harbinensis, Lactobacillus hayakitensis, Lactobacillus helveticus, Lactobacillus hilgardii, Lactobacillus homohiochii, Lactobacillus iners, Lactobacillus ingluviei, Lactobacillus intestinalis, Lactobacillus jensenii, Lactobacillus johnsonii, Lactobacillus kalixensis, Lactobacillus kefiranofaciens, Lactobacillus kefiri, Lactobacillus kimchii, Lactobacillus kitasatonis, Lactobacillus kunkeei, Lactobacillus leichmannii, Lactobacillus lindneri, Lactobacillus malefermentans, Lactobacillus mali, Lactobacillus manihotivorans, Lactobacillus mindensis, Lactobacillus mucosae, Lactobacillus murinus, Lactobacillus nagelii, Lactobacillus namurensis, Lactobacillus nantensis, Lactobacillus oligofermentans, Lactobacillus oris, Lactobacillus panis, Lactobacillus pantheris, Lactobacillus parabrevis, Lactobacillus parabuchneri, Lactobacillus paracollinoides, Lactobacillus parafarraginis, Lactobacillus parakefiri, Lactobacillus paralimentarius, Lactobacillus paraplantarum, Lactobacillus pentosus, Lactobacillus perolens, Lactobacillus plantarum, Lactobacillus pontis, Lactobacillus psittaci, Lactobacillus rennini, Lactobacillus reuteri, Lactobacillus rhamnosus, Lactobacillus rimae, Lactobacillus rogosae, Lactobacillus rossiae, Lactobacillus ruminis, Lactobacillus saerimneri, Lactobacillus sakei, Lactobacillus salivarius, Lactobacillus sanfranciscensis, Lactobacillus satsumensis, Lactobacillus secaliphilus, Lactobacillus sharpeae, Lactobacillus siliginis, Lactobacillus spicheri, Lactobacillus suebicus, Lactobacillus thailandensis, Lactobacillus ultunensis, Lactobacillus vaccinostercus, Lactobacillus vaginalis, Lactobacillus versmoldensis, Lactobacillus vini, Lactobacillus vitulinus, Lactobacillus zeae, Lactobacillus zymae; Leclercia* species, *Legionella* species: *Legionella adelaidensis, Legionella anisa, Legionella beliardensis, Legionella birminghamensis, Legionella bozemanii, Legionella brunensis, Legionella busanensis, Legionella cherrii, Legionella cincinnatiensis, Legionella donaldsonii, Legionella drancourtii, Legionella drozanskii, Legionella erythra, Legionella fairfieldensis, Legionella fallonii, Legionella feeleii, Legionella geestiana, Legionella* genomospecies, *Legionella gratiana, Legionella gresilensis, Legionella hackeliae, Legionella impletisoli, Legionella israelensis, Legionella jamestowniensis,* 'Candidatus *Legionella jeonii*', *Legionella jordanis, Legionella lansingensis, Legionella londiniensis, Legionella longbeachae, Legionella lytica, Legionella maceachernii, Legionella micdadei, Legionella moravica, Legionella nautarum, Legionella oakridgensis, Legionella parisiensis, Legionella pneumophila, Legionella quateirensis, Legionella quinlivanii, Legionella rowbothamii, Legionella rubrilucens, Legionella sainthelensi, Legionella santicrucis, Legionella shakespearei, Legionella spiritensis, Legionella steigerwaltii, Legionella taurinensis, Legionella tucsonensis, Legionella wadsworthii, Legionella waltersii, Legionella worsleiensis, Legionella yabuuchiae; Leminorella* species, *Leptospira* species: *Leptospira interrogans, Leptospira kirschneri, Leptospira noguchii, Leptospira alexanderi, Leptospira weilii, Leptospira* genomospecies 1, *Leptospira borgpetersenii, Leptospira santarosai, Leptospira inadai, Leptospira fainei, Leptospira broomii, Leptospira licerasiae, Leptospira biflexa, Leptospira meyeri, Leptospira wolbachii, Leptospira* genomospecies 3, *Leptospira* genomospecies 4, *Leptospira* genomospecies 5; *Lepromatous leprosy* (Danielssen-Boeck disease), *Leptospira canicola, Leptospira hebdomadis, Leptospirosis* (Weil disease/*Leptospira* icterohaemorrhagiae/*Leptospira interrogans* serovar icterohaemorrhagiae), *Leptotrichia, Leuconostoc* species: *Leuconostoc carnosum, Leuconostoc citreum, Leuconostoc durionis, Leuconostoc fallax, Leuconostoc ficulneum, Leuconostoc fructosum, Leuconostoc garlicum, Leuconostoc gasicomitatum, Leuconostoc gelidum, Leuconostoc inhae, Leuconostoc kimchii, Leuconostoc lactis, Leuconostoc mesenteroides, Leuconostoc pseudoficulneum, Leuconostoc pseudomesenteroides; Listeria* species: *Listeria grayi, Listeria innocua, Listeria ivanovii, Listeria monocytogenes* (Listeriosis), *Listeria seeligeri, Listeria welshimeri; Methanobacterium extroquens, Microbacterium multiforme, Micrococcus* species: *Micrococcus antarcticus, Micrococcus flavus, Micrococcus luteus, Micrococcus lylae, Micrococcus mucilaginosis, Micrococcus roseus, Micrococcus sedentarius; Mobiluncus, Moellerella* species, *Morganella* species, *Moraxella* species: *Moraxella atlantae, Moraxella boevrei, Moraxella bovis, Moraxella canis, Moraxella caprae, Moraxella catarrhalis* (Branhamella *catarrhalis*), *Moraxella caviae, Moraxella cuniculi, Moraxella equi, Moraxella lacunata, Moraxella lincolnii, Moraxella nonliquefaciens, Moraxella oblonga, Moraxella osloensis, Moraxella saccharolytica; Morganella morganii, Mycobacterium* species: *Mycobacterium abscessus, Mycobacterium africanum, Mycobacterium agri, Mycobacterium aichiense, Mycobacterium alvei, Mycobacterium arupense, Mycobacterium asiaticum, Mycobacterium aubagnense, Mycobacterium aurum, Mycobacterium austroafricanum, Mycobacterium avium* (Battey disease/Lady Windermere syndrome), *Mycobacterium avium* paratuberculosis (implicated in Crohn's disease in humans and Johne's disease in sheep), *Mycobacterium avium silvaticum, Mycobacterium avium* "hominissuis", *Mycobacterium colombiense, Mycobacterium boenickei, Mycobacterium bohemicum, Mycobacterium bolletii, Mycobacterium botniense, Mycobacterium bovis* (Bovine tuberculosis), *Mycobacterium branderi, Mycobacterium brisbanense, Mycobacterium brumae, Mycobacterium canariasense, Mycobacterium caprae, Mycobacterium celatum, Mycobacterium chelonae, Mycobacterium chimaera, Mycobacterium chitae, Mycobacterium chlorophenolicum, Mycobacterium chubuense, Mycobacterium conceptionense, Mycobacterium confluentis, Mycobacterium conspicuum, Mycobacterium cookii, Mycobacterium cosmeticum, Mycobacterium diernhoferi, Mycobacterium doricum, Mycobacterium duvalii, Mycobacterium elephantis, Mycobacterium fallax, Mycobacterium farcinogenes, Mycobacterium flavescens, Mycobacterium florentinum, Mycobacterium fluoroan-*

*thenivorans, Mycobacterium fortuitum, Mycobacterium fortuitum* subsp. *Acetamidolyticum, Mycobacterium frederiksbergense, Mycobacterium gadium, Mycobacterium gastri, Mycobacterium genavense, Mycobacterium gilvum, Mycobacterium goodii, Mycobacterium gordonae* (*Mycobacterium* aquae), *Mycobacterium haemophilum, Mycobacterium hassiacum, Mycobacterium heckeshornense, Mycobacterium heidelbergense, Mycobacterium hiberniae, Mycobacterium hodleri, Mycobacterium holsaticum, Mycobacterium houstonense, Mycobacterium immunogenum, Mycobacterium interjectum, Mycobacterium intermedium, Mycobacterium intracellulare, Mycobacterium kansasii, Mycobacterium komossense, Mycobacterium kubicae, Mycobacterium kumamotonense, Mycobacterium lacus, Mycobacterium lentiflavum, Mycobacterium leprae* (causes leprosy or Hansen disease/Hanseniasis), *Mycobacterium lepraemurium, Mycobacterium madagascariense, Mycobacterium mageritense, Mycobacterium malmoense, Mycobacterium marinum* (Fish tank granuloma), *Mycobacterium massiliense, Mycobacterium microti, Mycobacterium monacense, Mycobacterium montefiorense, Mycobacterium moriokaense, Mycobacterium mucogenicum, Mycobacterium murale, Mycobacterium nebraskense, Mycobacterium neoaurum, Mycobacterium neworleansense, Mycobacterium nonchromogenicum, Mycobacterium novocastrense, Mycobacterium obuense, Mycobacterium palustre, Mycobacterium parafortuitum, Mycobacterium parascrofulaceum, Mycobacterium parmense, Mycobacterium peregrinum, Mycobacterium phlei, Mycobacterium phocaicum, Mycobacterium pinnipedii, Mycobacterium porcinum, Mycobacterium poriferae, Mycobacterium pseudoshottsii, Mycobacterium pulveris, Mycobacterium psychrotolerans, Mycobacterium pyrenivorans, Mycobacterium rhodesiae, Mycobacterium saskatchewanense, Mycobacterium scrofulaceum, Mycobacterium senegalense, Mycobacterium seoulense, Mycobacterium septicum, Mycobacterium shimoidei, Mycobacterium shottsii, Mycobacterium simiae, Mycobacterium smegmatis, Mycobacterium sphagni, Mycobacterium szulgai, Mycobacterium terrae, Mycobacterium thermoresistibile, Mycobacterium tokaiense, Mycobacterium triplex, Mycobacterium triviale, Mycobacterium tuberculosis* (major cause of human tuberculosis), *Mycobacterium bovis, Mycobacterium africanum, Mycobacterium canetti, Mycobacterium caprae, Mycobacterium pinnipedii', Mycobacterium tusciae, Mycobacterium ulcerans* (causes Bairnsdale ulcer/Buruli ulcer), *Mycobacterium vaccae, Mycobacterium vanbaalenii, Mycobacterium wolinskyi, Mycobacterium xenopi; Mycoplasma* species: *Mycoplasma fermentans, Mycoplasma genitalium, Mycoplasma hominis, Mycoplasma penetrans, Mycoplasma phocacerebrale, Mycoplasma pneumoniae, Nanukayami* (Seven-day fever/Gikiyami), *Neisseria* species: *Neisseria gonorrhoea* (Gonococcus/Gonorrhea), *Neisseria meningitidis* (Meningococcus), *Neisseria sicca, Neisseria cinerea, Neisseria elongata, Neisseria flavescens, Neisseria lactamica, Neisseria mucosa, Neisseria polysaccharea, Neisseria subflava; Nitrobacter* species, *Nocardia* species: *Nocardia asteroides, Nocardia brasiliensis, Nocardia caviae; Noma* (cancrum oris/gangrenous stomatitis), *Obesumbacterium, Oligotropha* species, *Orientia tsutsugamushi* (Scrub typhus), *Oxalobacter formigenes, Pantoea* species: *Pantoea agglomerans, Pantoea ananatis, Pantoea citrea, Pantoea dispersa, Pantoea punctata, Pantoea stewartii, Pantoea terrea; Pasteurella* species: *Pasteurella aerogenes, Pasteurella anatis, Pasteurella avium, Pasteurella bettyae, Pasteurella caballi, Pasteurella canis, Pasteurella dagmatis, Pasteurella gallicida, Pasteurella gallinarum, Pasteurella granulomatis, Pasteurella langaaensis, Pasteurella lymphangitidis, Pasteurella mairii, Pasteurella multocida, Pasteurella pneumotropica, Pasteurella skyensis, Pasteurella stomatis, Pasteurella testudinis, Pasteurella trehalosi, Pasteurella tularensis, Pasteurella ureae, Pasteurella volantium; Pediococcus* species: *Pediococcus acidilactici, Pediococcus cellicola, Pediococcus claussenii, Pediococcus damnosus, Pediococcus dextrinicus, Pediococcus ethanolidurans, Pediococcus inopinatus, Pediococcus parvulus, Pediococcus pentosaceus, Pediococcus stilesii; Peptostreptococcus* species: *Peptostreptococcus anaerobius, Peptostreptococcus asaccharolyticus, Peptostreptococcus harei, Peptostreptococcus hydrogenalis, Peptostreptococcus indoliticus, Peptostreptococcus ivorii, Peptostreptococcus lacrimalis, Peptostreptococcus lactolyticus, Peptostreptococcus magnus, Peptostreptococcus micros, Peptostreptococcus octavius, Peptostreptococcus prevotii, Peptostreptococcus tetradius, Peptostreptococcus vaginalis; Photorhabdus* species, *Photorhizobium* species, *Plesiomonas shigelloides, Porphyromonas gingivalis, Pragia* species, *Prevotella, Propionibacterium* species: *Propionibacterium acnes, Propionibacterium propionicus; Proteus* species: *Proteus mirabilis, Proteus morganii, Proteus penneri, Proteus rettgeri, Proteus vulgaris; Providencia* species: *Providencia friedericiana, Providencia stuartii; Pseudomonas* species: *Pseudomonas aeruginosa, Pseudomonas alcaligenes, Pseudomonas anguilliseptica, Pseudomonas argentinensis, Pseudomonas borbori, Pseudomonas citronellolis, Pseudomonas flavescens, Pseudomonas mendocina, Pseudomonas nitroreducens, Pseudomonas oleovorans, Pseudomonas pseudoalcaligenes, Pseudomonas resinovorans, Pseudomonas straminea, Pseudomonas aurantiaca, Pseudomonas aureofaciens, Pseudomonas chlororaphis, Pseudomonas fragi, Pseudomonas lundensis, Pseudomonas taetrolens, Pseudomonas Antarctica, Pseudomonas azotoformans, Pseudomonas brassicacearum, Pseudomonas brenneri, Pseudomonas cedrina, Pseudomonas corrugate, Pseudomonas fluorescens, Pseudomonas gessardii, Pseudomonas libanensis, Pseudomonas mandelii, Pseudomonas marginalis, Pseudomonas mediterranea, Pseudomonas meridiana, Pseudomonas migulae, Pseudomonas mucidolens, Pseudomonas orientalis, Pseudomonas panacis, Pseudomonas proteolytica, Pseudomonas rhodesiae, Pseudomonas synxantha, Pseudomonas thivervalensis, Pseudomonas tolaasii, Pseudomonas veronii, Pseudomonas denitrificans, Pseudomonas pertucinogena, Pseudomonas cremoricolorata, Pseudomonas fulva, Pseudomonas monteilii, Pseudomonas mosselii, Pseudomonas oryzihabitans, Pseudomonas parafulva, Pseudomonas plecoglossicida, Pseudomonas putida, Pseudomonas balearica, Pseudomonas luteola, Pseudomonas stutzeri, Pseudomonas amygdale, Pseudomonas avellanae, Pseudomonas caricapapayae, Pseudomonas cichorii, Pseudomonas coronafaciens, Pseudomonas ficuserectae, Pseudomonas meliae, Pseudomonas savastanoi, Pseudomonas syringae, Pseudomonas viridiflava, Pseudomonas abietaniphila, Pseudomonas acidophila, Pseudomonas agarici, Pseudomonas alcaliphila, Pseudomonas alkanolytica, Pseudomonas amyloderamosa, Pseudomonas asplenii, Pseudomonas azotifigens, Pseudomonas cannabina, Pseudomonas coenobios, Pseudomonas congelans, Pseudomonas costantinii, Pseudomonas cruciviae, Pseudomonas delhiensis, Pseudomonas excibis, Pseudomonas extremorientalis, Pseudomonas frederiksbergensis, Pseudomonas fuscovaginae, Pseudomonas gelidicola, Pseudomonas grimontii, Pseudomonas indica, Pseudomonas jessenii, Pseudomonas jinjuensis, Pseudomonas kilo-*

*nensis, Pseudomonas knackmussii, Pseudomonas koreensis, Pseudomonas lini, Pseudomonas lutea, Pseudomonas moraviensis, Pseudomonas otitidis, Pseudomonas pachastrellae, Pseudomonas palleroniana, Pseudomonas papaveris, Pseudomonas peli, Pseudomonas perolens, Pseudomonas poae, Pseudomonas pohangensis, Pseudomonas psychrophila, Pseudomonas psychrotolerans, Pseudomonas rathonis, Pseudomonas reptilivora, Pseudomonas resiniphila, Pseudomonas rhizosphaerae, Pseudomonas rubescens, Pseudomonas salomonii, Pseudomonas segitis, Pseudomonas septica, Pseudomonas simiae, Pseudomonas suis, Pseudomonas thermotolerans, Pseudomonas tremae, Pseudomonas trivialis, Pseudomonas turbinellae, Pseudomonas tuticorinensis, Pseudomonas umsongensis, Pseudomonas vancouverensis, Pseudomonas vranovensis, Pseudomonas xanthomarina; Rahnella species, Ralstonia species: Ralstonia basilensis, Ralstonia campinensis, Ralstonia eutropha, Ralstonia gilardii, Ralstonia insidiosa, Ralstonia mannitolilytica, Ralstonia metallidurans, Ralstonia paucula, Ralstonia pickettii, Ralstonia respiraculi, Ralstonia solanacearum, Ralstonia syzygii, Ralstonia taiwanensis; Raoultella species, Rhodoblastus species, Rhodopseudomonas species, Rhinoscleroma, Rhizobium radiobacter, Rhodococcus equi, Rickettsia species: Rickettsia africae, Rickettsia akari, Rickettsia australis, Rickettsia conorii, Rickettsia felis, Rickettsia japonica, Rickettsia mooseri, Rickettsia prowazekii* (Typhus fever), *Rickettsia rickettsii, Rickettsia siberica, Rickettsia typhi, Rickettsia conorii, Rickettsia africae, Rickettsia psittaci, Rickettsia quintana, Rickettsia rickettsii, Rickettsia trachomae; Rothia dentocariosa, Salmonella species: Salmonella arizonae, Salmonella Bongori, Salmonella enterica, Salmonella enteriditis, Salmonella paratyphi, Salmonella typhi* (Typhoid fever), *Salmonella typhimurium, Salmonella salamae, Salmonella arizonae, Salmonella diarizonae, Salmonella houtenae, Salmonella indica; Samsonia species, Serratia species: Serratia entomophila, Serratia ficaria, Serratia fonticola, Serratia grimesii, Serratia liquefaciens, Serratia marcescens, Serratia odoriferae, Serratia plymuthica, Serratia proteamaculans, Serratia quinivorans, Serratia rubidaea, Serratia ureilytica; Shewanella putrefaciens, Shigella boydii, Shigella dysenteriae, Shigella flexneri, Shigella sonnei, Sodalis species, Spirillum species: Spirillum minus rat bite fever, Staphylococcus species: Staphylococcus aureus, Staphylococcus auricularis, Staphylococcus capitis, Staphylococcus caprae, Staphylococcus cohnii, Staphylococcus epidermidis, Staphylococcus felis, Staphylococcus haemolyticus, Staphylococcus hominis, Staphylococcus intermedius, Staphylococcus lugdunensis, Staphylococcus pettenkoferi, Staphylococcus saprophyticus, Staphylococcus schleiferi, Staphylococcus simulans, Staphylococcus vitulus, Staphylococcus warneri, Staphylococcus xylosus; Stenotrophomonas species: Stenotrophomonas acidaminiphila, Stenotrophomonas dokdonensis, Stenotrophomonas koreensis, Stenotrophomonas maltophilia, Stenotrophomonas nitritireducens, Stenotrophomonas rhizophila; Streptobacillus species: Streptobacillus moniliformis* (Streptobacillary rat bite fever); *Streptococcus species: Streptococcus* Group A, *Streptococcus* Group B, *Streptococcus agalactiae, Streptococcus aginosus, Streptococcus avium, Streptococcus bovis, Streptococcus canis, Streptococcus cricetus, Streptococcus faceium, Streptococcus faecalis, Streptococcus ferus, Streptococcus gallinarum, Streptococcus lactis, Streptococcus milleri, Streptococcus mitior, Streptococcus mitis, Streptococcus mutans, Streptococcus oralis, Streptococcus peroris, Streptococcus pneumoniae, Streptococcus pyogenes, Streptococcus ratti, Streptococcus salivarius, Streptococcus sanguinis, Streptococcus sobrinus, Streptococcus parasanguinis, Streptococcus suis, Streptococcus thermophilus, Streptococcus vestibularis, Streptococcus viridans, Streptococcus uberis, Streptococcus zooepidemicus; Tatumella species, Trabulsiella species, Treponema species: Treponema carateum* (Pinta), *Treponema denticola, Treponema endemicum* (Bejel), *Treponema pallidum* (Syphilis), *Treponema pertenue* (Yaws); *Tropheryma whipplei* (Whipple disease), Tuberculoid leprosy, *Ureaplasma urealyticum, Veillonella, Vibrio* species: *Vibrio aerogenes, Vibrio aestuarianus, Vibrio agarivorans, Vibrio albensis, Vibrio alginolyticus, Vibrio brasiliensis, Vibrio calviensis, Vibrio campbellii, Vibrio chagasii, Vibrio cholerae* (Cholera), *Vibrio cincinnatiensis, Vibrio Comma, Vibrio coralliilyticus, Vibrio crassostreae, Vibrio cyclitrophicus, Vibrio diabolicus, Vibrio diazotrophicus, Vibrio ezurae, Vibrio fischeri, Vibrio fluvialis, Vibrio fortis, Vibrio furnissii, Vibrio gallicus, Vibrio gazogenes, Vibrio gigantis, Vibrio halioticoli, Vibrio harveyi, Vibrio hepatarius, Vibrio hispanicus, Vibrio ichthyoenteri, Vibrio kanaloae, Vibrio lentus, Vibrio litoralis, Vibrio logei, Vibrio mediterranei, Vibrio metschnikovii, Vibrio mimicus, Vibrio mytili, Vibrio natriegens, Vibrio navarrensis, Vibrio neonatus, Vibrio neptunius, Vibrio nereis, Vibrio nigripulchritudo, Vibrio ordalii, Vibrio orientalis, Vibrio pacinii, Vibrio parahaemolyticus, Vibrio pectenicida, Vibrio penaeicida, Vibrio pomeroyi, Vibrio ponticus, Vibrio proteolyticus, Vibrio rotiferianus, Vibrio ruber, Vibrio rumoiensis, Vibrio salmonicida, Vibrio scophthalmi, Vibrio splendidus, Vibrio superstes, Vibrio tapetis, Vibrio tasmaniensis, Vibrio tubiashii, Vibrio vulnificus, Vibrio wodanis, Vibrio xuii; Vogesella indigofera, Wigglesworthia species, Wolbachia secies, Xenorhabdus species, Yersinia enterocolitica, Yersinia pestis, Yersinia pseudotuberculosis,* and *Yokenella* species.

1344. The method for vaccination according to item 1172, wherein the vaccination is for treatment of one or more infectious diseases.

1345. The method for vaccination according to item 1344, wherein the one orm ore infectious diseases can be selected from the group consisting of Bacteria and bacterial diseases (Specific kind of Infections), Fungus and fungal infections (Specific kind of Infections), Helminths and helminthic conditions (Specific kind of Infections), Prions and prion related diseases (Specific kind of Infections), Protozoa and protozoal infections (Specific kind of Infections), Viruses and viral disease (Specific kind of Infections), Abscess, Acariasis, actinomycetoma, Adenitis, Adenoiditis, African trypanosomiasis, Alpers Syndrome, Alphos, Alveolar osteitis, Amebiasis, Anorectal abscess, Anthrax, Ascariasis, Aspergillosis, Athlete's foot, Atypical pneumonia, Babesiosis, Bejel, Blastocystis *hominis*, Blastomycosis, Bolivian hemorrhagic fever, Botulism, Botryomycosis, Borna disease, Borreliosis (Lyme disease), Bovine spongiform encephalopathy, Brazilian purpuric fever (BPF), Bronchiolitis, Brucellosis, Bubonic plague, Buruli ulcer, Candidiasis, Campylobacteriosis, Cat scratch fever, Cellulitis, Chagas disease, Chalazion, Chickenpox (Varicella), Chikungunya, Cholangitis, Cholecystitis, Cholera, Clonorchiasis, Coccidioidomycosis, Colorado Tick Fever (CTF), Common cold, Creutzfeldt-Jakob disease, Crimean-Congo hemorrhagic fever, Cryptococcosis, Cryptosporidiosis, Cutaneous abscess, Cysticercosis, Cystitis, infective, Dengue fever, Dermatophytosis, Diarrheal diseases, Diphteria, Diphyllobothriasis, Discitis, Donovanosis, Dracunculiasis, Dukes' disease, Dysentery, Ebola hemorrhagic fever, Echinococcosis, Encephalitis, Enterobiasis, Epidural abscess, Erysipelas, Eumycetoma, Fascioliasis, Fatal Familial Insomnia, Filariasis, Finger pulp abscess, Fitz-Hugh-Curtis syndrome, Foodborne trematodiases, Foot-and-mouth disease, Gallbladder empyema, Gas gangrene, Gastroenteritis, Giardiasis, Glanders, Gnathostomiasis, Gonorrhea, Gradenigo-Lannois syndrome, Grisel syndrome, Helminthiasis, Hepatitis, Herpes simplex, Herpes zoster, HPV, Histoplasmosis, HIV/AIDS, Hookworm, Hordeolum externum, Human African trypanosomiasis, Hymenolepiasis, Impetigo, Infectious mononucleosis, Influenza, Intertrigo, Intracranial abscess/granuloma, Intraspinal abscess/granuloma, Isosporiasis, IV catheter infection, Japanese Encephalitis, Kuru, Kyasanur forest disease, Labrea fever, La Crosse encephalitis, Lacrimal canaliculitis, Lady Windermere syndrome, Laryngeal papillomatosis, Laryngitis, Lassa fever, Legionellosis, Leishmaniasis, Lemierre's syndrome, Leptospirosis, Leprosy, Listeriosis, Liver abscess, Loa loa filariasis, lobomycosis, Lower respiratory tract infection, Ludwig angina, Lung abscess, Lymphangitis, Lymphatic filariasis, Malaria, Marburg haemorrhagic fever, Measles, Mediastinitis, Melioidosis, Meningitis, Metagonimiasis, Mumps, Murrain, Mycetoma, Mycosis, Myiasis, Necrotizing fasciitis, Neurocysticercosis, Nocardiosis, Omphalitis, Onchocerciasis, Ophthalmia neonatorum, Orbital cellulitis, Oropouche fever, Oroya fever, Osteomyelitis, Paragonimiasis, Paratyphoid fevers, Pediculosis, Periorbital cellulitis, Periodontis, Pertussis (Whooping Cough), Pharyngitis, Pharyngoconjunctival fever, Phlegmon, Pigbel (enteritis necroticans), Pinta, Pinworm Infection, Plantar wart, Pneumonia, Pneumonic plague, Pogosta disease, Poliomyelitis, Pott's disease, Prostatitis, Protothecosis, Psittacosis, Pyelonephritis acute, Pyelonephritis chronic, Pyomyositis, Q fever, Quinsy, Rabies, Rat-bite fever, Relapsing fever, Retropharyngeal abscess, Rheumatic Fever, Rhinosporidiosis, Rickettsialpox, Rift Valley fever, Ringworm, Rodentoleposis, Rocky Mountain Spotted Fever (RMSF), Roseola, Rubella, Salmonellosis, Scabies, Scarlet fever, Schistosomiasis, Septicemic plague, Septic arthropathy, Septic shock, Sepsis, Severe acute respiratory syndrome (SARS), Sexually transmissable disease, Shigellosis, Smallpox (Variola), Sodoku, Spondylodiskitis, Strongyloidiasis, Subdiaphragmatic abscess, Subdural empyema, Suppurative thyroiditis, Surra, Sweating sickness, Syphilis, Taeniasis, Tetanus, Trachoma, Tick-borne diseases, Tinea barbae, Tinea capitis, Tinea corporis, Tinea cruris, Tinea faciei, Tinea manuum, Tinea nigra, Tinea pedis, Tinea versicolor, Tonsillitis, Toxocariasis, Toxoplasmosis, Tracheolaryngobronchitis, Trachoma, Transmissible spongiform encephalopathy, Traveler's diarrhea, Trench fever, Treponematoses, Trichinellosis, Trichinosis, Trichomoniasis, Trichuriasis, Tropical diseases, Trypanosomiasis, Tuberculosis (TB), Tularemia, Typhoid fever, Typhus, Upper respiratory tract infection, Urethritis, Urinary tract infection, Venezuelan hemorrhagic fever (VHF), Verruca plana, viral hemorrhagic fevers (VHFs), Wart, West Nile disease, Wound infection, Yaws, Yellow fever, Yersiniosis and Zygomycosis.

1346. The method for vaccination according to item 1172, wherein the vaccination is for treatment of one or more cancer diseases.

1347. The method for vaccination according to item 1346, wherein the one or more cancer diseases can be selected from the group consisting of Acute Lymphoblastic Leukemia, Acute Myeloid Leukemia, Adrenocortical Carcinoma, AIDS-Related Cancers, AIDS-Related Lymphoma, Anal Cancer, Astrocytoma (e.g. Childhood Cerebellar or Childhood Cerebral), Basal Cell Carcinoma, Extrahepatic Bile Duct Cancer, Bladder Cancer, Bone Cancer, Osteosarcoma/Malignant Fibrous Histiocytoma, Brain Stem Glioma, Brain Tumor, Breast Cancer, Male Breast Cancer, Bronchial Adenomas/Carcinoids, Burkitt's Lymphoma, Carcinoid Tumor, Carcinoma of Unknown Primary, Primary Central Nervous System Lymphoma, Cerebral Astrocytoma/Malignant Glioma, Cervical Cancer, Childhood Cancers, Chronic Lymphocytic Leukemia, Chronic Myelogenous Leukemia, Chronic Myeloproliferative Disorders, Colon Cancer, Cutaneous T-Cell Lymphoma, Endometrial Cancer, Ependymoma (such as Childhood Epdndymoma), Esophageal Cancer, Ewing's Family of Tumors, Extracranial Germ Cell Tumor (such as Childhood Extracranial Germ Cell Tumor), Extragonadal Germ Cell Tumor, Eye Cancer (Intraocular Melanoma or Retinoblastoma), Gallbladder Cancer, Gastric (Stomach) Cancer, Gastrointestinal Carcinoid Tumor, Gestational Trophoblastic Tumor, Glioma, Hairy Cell Leukemia, Head and Neck Cancer, Hepatocellular (Liver) Cancer, Hodgkin's Lymphoma, Hypopharyngeal Cancer, Hypothalamic and Visual Pathway Glioma (such as Childhood Hypothalamic and Visual Pathway Glioma), Intraocular Melanoma, Islet Cell Carcinoma (Endocrine Pancreas), Kaposi's Sarcoma, Kidney (Renal Cell) Cancer, Laryngeal Cancer, Lip and Oral Cavity Cancer, Lung Cancer (Non-Small Cell or Small Cell), Lymphoma (such as AIDS-Related Lymphoma, Burkitt's Lymphoma, Cutaneous T-Cell Lymphoma, Non-Hodgkin's Lymphoma), Macroglobulinemia (such as Waldenström's Macroglobulinemia), Malignant Fibrous Histiocytoma of Bone/Osteosarcoma, Medulloblastoma (such as Childhood Medulloblastoma), Melanoma, Merkel Cell Carcinoma, Mesothelioma (such as Adult Malignant Mesothelioma or childhood Mesothelioma), Metastatic Squamous Neck Cancer with Occult Primary, Multiple Endocrine Neoplasia Syndrome (such as occurring in childhood), Multiple Myeloma/Plasma Cell Neoplasm, Mycosis Fungoides, Myelodysplastic Syndromes, Myelodysplastic/Myeloproliferative Diseases, Myeloma (such as Multiple Myeloma), Chronic myeloproliferative disorders, Nasal Cavity and Paranasal Sinus Cancer, Nasopharyngeal Cancer, Nasopharyngeal Cancer (such as Childhood Nasopharyngeal Cancer), Neuroblastoma, Oropharyngeal Cancer, Osteosarcoma/Malignant Fibrous Histiocytoma of Bone, Ovarian Cancer (such as Childhood Ovarian Cancer), Ovarian Epithelial Cancer, Ovarian Germ Cell Tumor, Ovarian Low Malignant Potential Tumor, Pancreatic Cancer, Pancreatic Cancer, Paranasal Sinus and Nasal Cavity Cancer, Parathyroid Cancer, Penile Cancer, Pheochromocytoma, Pineoblastoma and Supratentorial Primitive Neuroectodermal Tumors, Pituitary Tumor, Pleuropulmonary Blastoma, Prostate Cancer, Renal Pelvis and Ureter Transitional Cell Cancer, Retinoblastoma, Rhabdomyosarcoma (such as Childhood Rhabdomyosarcoma), Salivary Gland Cancer, Adult-onset soft tissue Sarcoma, Soft Tissue Sarcoma (such as Childhood Soft Tissue Sarcoma), uterine Sarcoma, Sezary Syndrome, Skin Cancer (such as non-Melanoma skin cancer), Merkel Cell Skin Carcinoma, Small Intestine Cancer, Supratentorial Primitive Neuroectodermal Tumors (such as occurring in Childhood), Cutaneous T-Cell Lymphoma, Testicular Cancer, Thymoma and Thymic Carcinoma, Thyroid Cancer, Transitional Cell Cancer of the Renal Pelvis and Ureter, Trophoblastic Tumor (such as Gestational Trophoblastic Tumor), Urethral Cancer, Endometrial uterine cancer, Uterine Sarcoma, Vaginal Cancer, Visual Pathway and Hypothalamic Glioma (such as Childhood Visual Pathway and Hypothalamic Glioma), Waldenström's Macroglubulinemia and Wilms' Tumor.

1348. The method for vaccination according to item 1172, wherein the vaccination is for treatment of one or more diseases selected from the group consisting of diseases of inflammatory, auto-immune, allergic, viral, cancerous, infectious, allo- or xenogene (graft versus host and host versus graft) origin.

1349. The method for vaccination according to item 1172, wherein the vaccination is for treatment of one or more diseases selected from the group consisting of chronic inflammatory bowel disease such as Crohn's disease or ulcerative colitis, sclerosis, type I diabetes, rheumatoid arthritis, psoriasis, atopic dermatitis, asthma, malignant melanoma, renal carcinoma, breast cancer, lung cancer, cancer of the uterus, prostatic cancer, brain cancer, head and neck cancer, leukaemia, cutaneous lymphoma, hepatic carcinoma, colorectal cancer, bladder cancer, rejection-related disease, Graft-versus-host-related disease, or a viral disease associated with hepatitis, AIDS, measles, pox chicken pox, rubella or herpes.

1350. The method for vaccination according to item 1172, wherein the vaccination is for treatment of one or more diseases selected from the group consisting of a disease of inflammatory/auto-immune origin, including asthma, hypersensitivity pneumonitis, interstitial lung disease, sarcoidosis, idiopathic pulmonary fibrosis, interstitial lung disease associated with Crohn s Disease or ulcerative colitis or Whipple's disease, interstitial lung disease associated with Wegeners granulomatosis or hypersensitivity vasculitis, vasculitis syndromes, Hennoch-Schonleins purpura, Goodpastures syndrome, Wegeners granulomatosis, renal diseases such as antibody mediated glomerulopathia as in acute glomerulonephritis, nephritis associated with systemic lupus erythematosus, nephritis associated with other systemic diseases such as Wegeners granulomatosis and Goodpastures syndrome and mixed connective tissue disease, chronic interstitial nephritis, chronic glomerulonephritis, gastrointestinal diseases such as Crohn s Disease, Ulcerative colitis, coeliac disease, Whipple's disease, collagenous colitis, eosinophillic colitis, lymphatic colitis, hepatobilliary diseases such as auto-immune hepatitis, alcohol induced hepatitis, periportal fibrosis, primary billiary cirrhosis, sclerosing colangitis, disorders of the central or peripheral nervous system such as demyelinating disease as multiple sclerosis, acute disseminated encephalomyelitis, sub-acute sclerosing panencephalitis, skin disease such as psoriasis, atopic dermatitis, eczema, allergic skin disease, progressive systemic sclerosis (scleroderma), exfoliating dermatitis, pemphigus vulgaris, joint diseases such as rheumatoid arthritis, ankylosing spondylitis, arthritis associated with psoriasis or inflammatory bowel disease, muscoloskelletal diseases such as myastenia gravis, polymyositis, endocrine diseases such as insulin dependent diabetes mellitus, auto-immune thyroiditis (Hashimoto), thyreotoxicosis, Graves, diseases of the hematopoetic system such as auto-immune anaemia, auto-immune thrombocytopenia, cardiovascular diseases such as cardiomyopathia, vasculitis, cardiovascular disease associated with systemic diseases as systemic lupus erythematosus, polyarthritis nodosa, rheumatoid arthritis, scleroderma, sarcoidosis, diseases of cancerous origin, including malignant melanoma, Sezary's syndrome, cutaneous T-cell lymphoma, renal cell carcinoma, colorectal cancer, breast cancer, ovarian cancer, cancer of the uterus, prostatic cancer, hepatic carcinoma, lung cancer, and sarcoma, and diseases, disorders or conditions of allergic origin.

1351. The method for vaccination according to item 1172, wherein the vaccination is for treatment of one or more diseases selected from the group consisting of autoimmune diseases including multiple sclerosis, type I diabetes mellitus, Hashimotos thyroiditis, pernicious anemia, Addison's disease, myasthenia gravis, rheumatoid arthritis, uveitis, psoriasis, Guillain-Barre Syndrome and Grave's disease, systemic lupus erythematosus and dermatomyositis.

1352. The method for vaccination according to item 1172, wherein the vaccination is for treatment of one or more diseases selected from the group consisting of hypersensitivity disorders like asthma, eczema, atopical dermatitis, contact dermatitis, other eczematous dermatitides, seborrheic dermatitis, rhinitis, Lichen planus, Pemplugus, bullous Pemphigoid, Epidermolysis bullosa, uritcaris, angioedemas, vasculitides, erythemas, cutaneous eosinophilias, Alopecia areata, atherosclerosis, primary biliary cirrhosis and nephrotic syndrome.

1353. The method for vaccination according to item 1172, wherein the vaccination is for treatment of one or more diseases selected from the group consisting of intestinal inflammations, such as Coeliac disease, proctitis, eosinophilia gastroenteritis, mastocytosis, inflammatory bowel disease, Chrohn's disease and ulcerative colitis, as well as food-related allergies.

1354. The method for vaccination according to item 1172, wherein the vaccination is for treatment of one or more allergic diseases.

1355. The method for vaccination according to item 1354, wherein the allergic diseases involve one or more of the allergens selected from the group consisting of inhalation allergens originating i. a. from trees, grasses, herbs, fungi, house dust mites, storage mites, cockroaches and animal hair, feathers, and dandruff, pollen allergens from trees, grasses and herbs are such originating from the taxonomic orders of Fagales, Oleales and Pinales including i. a. birch (*Betula*), alder (*Alnus*), hazel (*Corylus*), hornbeam (*Carpinus*) and olive (*Olea*), the order of Poales including i. a. grasses of the genera *Lolium, Phleum, Poa, Cynodon, Dactylis* and *Secale*, the orders of Astrales and Urticales including i. a. herbs of the genera *Ambrosia* and *Artemisia*, inhalation allergens from fungi, allergens originating from the genera *Alternaria* and *Cladosporium*, inhalation allergens from house dust mites of the genus *Dermatophagoides*, storage mites from the genus Lepidoglyphys destructor, those from cockroaches and those from mammals such as cat, dog, horse, cow, and bird.

1356. The method for vaccination according to item 1172, wherein the vaccination is for treatment of one or more diseases selected from the group consisting of Bet v 1 (*B. verrucosa*, birch), Aln g 1 (*Alnus glutinosa*, alder), Cor a 1 (*Corylus avelana*, hazel) and Car b 1 (*Carpinus betulus*, hornbeam) of the Fagales order, Cry j 1 (Pinales), Amb a 1 and 2, Art v 1 (Asterales), Par j 1 (Urticales), Ole e 1 (Oleaves), Ave e 1, Cyn d 1, Dac g 1, Fes p 1, Hol l 1, Lol p 1 and 5, Pas n 1, Phl p 1 and 5, Poa p 1, 2 and 5, Sec c 1 and 5, and Sor h 1 (various grass pollens), Alt a 1 and Cla h 1 (fungi), Der f 1 and 2, Der p 1 and 2 (house dust mites, *D. farinae* and *D. pteronyssinus*, respectively), Lep d 1, Bla g 1 and 2, Per a 1 (cockroaches, *Blatella germanica* and *Periplaneta americana*, respectively), Fel d 1 (cat), Can f 1 (dog), Equ c 1, 2 and 3 (horse), Apis m 1 and 2 (honeybee), Ves g 1, 2 and 5, Pol a 1, 2 and 5 (all wasps) and Sol i 1, 2, 3 and 4 (fire ant).

1357. The method for vaccination according to item 1172, wherein the vaccination results in up-regulation of the immune response of said individual.

1358. The method for vaccination according to item 1172, wherein the vaccination results in down-regulation of the immune response of said individual.

1359. The method for vaccination according to item 1172, wherein the vaccination results in modulation of the immune response of said individual.

1360. The method for vaccination according to item 1172, wherein the vaccination results in stimulation of the immune response of said individual.
1361. The method for vaccination according to item 1172, wherein the vaccination results in inhibition of the immune response of said individual.
1362. The method for vaccination according to item 1172, wherein the vaccination results in restoration of the immune response of said individual.
1363. The method for vaccination according to item 1172, wherein the vaccination results in induction of anergy in a cell.
1364. The method for vaccination according to item 1172, wherein the vaccination results in adoptive immunotherapy.
1365. The method for vaccination according to item 1172, wherein the vaccination comprises in vivo therapy and/or ex vivo therapy.
1366. The method for vaccination according to item 1172, wherein the vaccination comprises combination therapy such as co-administration of the composition according to item 1-1170 and one ore more medicaments.
1367. The method for vaccination according to item 1366, wherein the co-administration comprises that the composition according to item 1-1170 and the one ore more medicaments can be administered simultaneously.
1368. The method for vaccination according to item 1366, wherein the co-administration comprises that the composition according to item 1-1170 and the one ore more medicaments can be administered sequentially in any order.
1369. The method for vaccination according to item 1366, wherein the one ore more medicaments can be an anti-cancer medicament.
1370. The method for vaccination according to item 1366, wherein the one ore more medicaments can be an anti-cancer drug selected from the group consisting of
1371. The method for vaccination according to item 1366, wherein the one ore more medicaments can be an anti-HIV medicament.
1372. The method for vaccination according to item 1366, wherein the one ore more medicaments can be a chemotherapeutic agent.
1373. The method for vaccination according to item 1366, wherein the one ore more medicaments can be an immunotherapeutic agent.
1374. The method for vaccination according to item 1366, wherein the combination therapy comprises radiation therapy.
1375. The method for vaccination according to item 1366, wherein the combination therapy comprises gene therapy.
1376. The method for vaccination according to item 1366, wherein the combination therapy comprises surgery.
1377. The method for vaccination according to item 1366, wherein the one ore more medicaments can be selected from the group of chemotherapeutic agents including methotrexate, vincristine, adriamycin, cisplatin, non-sugar containing chloroethylnitrosoureas, 5-fluorouracil, mitomycin C, bleomycin, doxorubicin, dacarbazine, taxol, fragyline, Meglamine GLA, valrubicin, carmustaine and poliferposan, MM1270, BAY 12-9566, RAS famesyl transferase inhibitor, famesyl transferase inhibitor, MMP, MTA/LY231514, LY264618/Lometexol, Glamolec, CI-994, TNP-470, Hycamtin/Topotecan, PKC412, Valspodar/PSC833, Novantrone/Mitroxantrone, Metaret/Suramin, Batimastat, E7070, BCH-4556, CS-682, 9-AC, AG3340, AG3433, Incel/VX-710, VX-853, ZD0101, ISI641, ODN 698, TA 2516/Marmistat, BB2516/Marmistat, CDP 845, D2163, PD183805, DX8951f, Lemonal DP 2202, FK 317, Picibanil/OK-432, AD 32/Valrubicin, Metastron/strontium derivative, Temodal/Temozolomide, Evacet/liposomal doxorubicin, Yewtaxan/Placlitaxel, Taxol/Paclitaxel, Xeload/Capecitabine, Furtulon/Doxifluridine, Cyclopax/oral paclitaxel, Oral Taxoid, SPU-077/Cisplatin, HMR 1275/Flavopiridol, CP-358 (774)/EGFR, CP-609 (754)/RAS oncogene inhibitor, BMS-182751/oral platinum, UFT (Tegafur/Uracil), Ergamisol/Levamisole, Eniluracil/776C85/5FU enhancer, Campto/Levamisole, Camptosar/lrinotecan, Tumodex/Ralitrexed, Leustatin/Cladribine, Paxex/Paclitaxel, Doxil/liposomal doxorubicin, Caelyx/liposomal doxorubicin, Fludara/Fludarabine, Pharmarubicin/Epirubicin, DepoCyt, ZD1839, LU 79553/Bis-Naphtalimide, LU 103793/Dolastain, Caetyx/lliposomal doxorubicin, Gemzar/Gemcitabine, ZD 0473/Anormed, YM 116, Iodine seeds, CDK4 and CDK2 inhibitors, PARP inhibitors, D4809/Dexifosamide, Ifes/Mesnex/Ifosamide, Vumon/Teniposide, Paraplatin/Carboplatin, Plantinol/cisplatin, Vepeside/Etoposide, ZD 9331, Taxotere/Docetaxel, prodrug of guanine arabinoside, Taxane Analog, nitrosoureas, alkylating agents such as melphelan and cyclophosphamide, Aminoglutethimide, Asparaginase, Busulfan, Carboplatin, Chlorombucil, Cytarabine HCl, Dactinomycin, Daunorubicin HCl, Estramustine phosphate sodium, Etoposide (VP16-213), Floxuridine, Fluorouracil (5-FU), Flutamide, Hydroxyurea (hydroxycarbamide), Ifosfamide, Interferon Alfa-2a, Alfa-2b, Leuprolide acetate (LHRH-releasing factor analogue), Lomustine (CCNU), Mechlorethamine HCl (nitrogen mustard), Mercaptopurine, Mesna, Mitotane (o.p'-DDD), Mitoxantrone HCl, Octreotide, Plicamycin, Procarbazine HCl, Streptozocin, Tamoxifen citrate, Thioguanine, Thiotepa, Vinblastine sulfate, Amsacrine (m-AMSA), Azacitidine, Erthropoietin, Hexamethylmelamine (HMM), Interleukin 2, Mitoguazone (methyl-GAG; methyl glyoxal bis-guanylhydrazone; MGBG), Pentostatin (2'deoxycoformycin), Semustine (methyl-CCNU), Teniposide (VM-26) and Vindesine sulfate.
1378. The method for vaccination according to item 1366, wherein the one ore more medicaments can be selected from the group of anti-cancer drugs consisting of Aldesleukin/Proleukin (Chiron Corp), Alemtuzumab/Campath (Millennium and ILEX Partners, LP), alitretinoin/Panretin (Ligand Pharmaceuticals), allopurinol/Zyloprim (GlaxoSmithKline), altretamine/Hexalen (US Bioscience), amifostine/Ethyol (US Bioscience), anastrozole/Arimidex (AstraZeneca), arsenic trioxide/Trisenox (Cell Therapeutic), Asparaginase/Elspar (Merck & Co, Inc), BCG Live/TICE BCG (Organon Teknika Corp), bexarotene capsules/Targretin (Ligand Pharmaceuticals), bleomycin/Blenoxane (Bristol-Myers Squibb), busulfan/Busulfex (GlaxoSmithKline), calusterone/Methosarb (Pharmacia & Upjohn Company), capecitabine/Xeloda (Roche), carboplatin/Paraplatin (Bristol-Myers Squibb), carmustine/BCNU, BiCNU (Bristol-Myers Squibb), carmustine with Polifeprosan 20 Implant/Gliadel Wafer (Guilford Pharmaceuticals Inc.), celecoxib/Celebrex (Searle), chlorambucil/Leukeran (GlaxoSmithKline), cisplatin/Platinol (Bristol-Myers Squibb), cladribine/Leustatin, 2-CdA (R.W. Johnson Pharmaceutical Research Institute), cyclophosphamide Cytoxan/Neosar (Bristol-Myers Squibb), cytarabine/Cytosar-U (Pharmacia & Upjohn Company), dacarbazine/DTIC-Dome (Bayer), dactinomycin/actinomycin D Cosmegen (Merck), Darbepoetin alfa/Aranesp (Amgen, Inc), daunorubicin/daunomycin/Daunorubicin (Bedford Labs), daunorubicin/daunomycin/Cerubidine (Wyeth Ayerst), Denileukin/diftitox/Ontak (Seragen, Inc), dexrazoxane/Zinecard (Pharmacia & Upjohn Company), docetaxel/Taxotere (Aventis Pharmaceutical), doxorubicin Adriamycin/Rubex (Pharmacia & Upjohn Company), DROMOSTANOLONE PROPIONATE/MASTERONE INJECTION (SYNTEX), Elliott's B Solution (Orphan Medical, Inc), epirubicin/Ellence (Pharmacia & Upjohn Company), etoposide phosphate (Bristol-Myers Squibb), etoposide/VP-16/Vepesid (Bristol-Myers Squibb), exemestane/Aromasin (Pharmacia & Upjohn Company), Filgrastim/Neupogen (Amgen, Inc), floxuridine/FUDR (Roche), fludarabine/Fludara (Berlex Laboratories Inc.), fluorouracil/5-FU/Adrucil (ICN Puerto Rico), fulvestrant/ Faslodex (IPR), gemcitabine/Gemzar (Eli Lilly), gemtuzumab/ozogamicin/Mylotarg (Wyeth Ayerst), goserelin acetate/Zoladex Implant (AstraZeneca Pharmaceuticals), hydroxyurea/Hydrea (Bristol-Myers Squibb), Ibritumomab Tiuxetan/Zevalin (IDEC Pharmaceuticals Corp), idarubicin/ Idamycin (Adria Laboratories), ifosfamide/IFEX (Bristol-Myers Squibb), imatinib mesylate/Gleevec (Novartis), Interferon alfa-2a/Roferon-A (Hoffmann-La Roche Inc), Interferon alfa-2b/Intron A (Schering Corp), irinotecan/ Camptosar (Pharmacia & Upjohn Company), letrozole/Femara (Novartis), leucovorin Wellcovorin/Leucovorin (Immunex Corporation), levamisole/Ergamisol (Janssen Research Foundation), lomustine/CCNU/CeeBU (Bristol-Myers Squibb), meclorethamine/nitrogen mustard/Mustargen (Merck), megestrol acetate/Megace (Bristol-Myers Squibb), melphalan/L-PAM/Alkeran (GlaxoSmithKline), mercaptopurine/6-MP Purinethol (GlaxoSmithKline), mesna/Mesnex (Asta Medica), methotrexate (Lederle Laboratories), methoxsalen/Uvadex (Therakos), mitomycin C/Mutamycin (Bristol-Myers Squibb), mitomycin C/Mitozytrex (Supergen), mitotane/Lysodren (Bristol-Myers Squibb), mitoxantrone/Novantrone (Lederle Laboratories), nandrolone phenpropionate/Durabolin-50 (Organon), Nofetumomab/Verluma (Boehringer Ingelheim Pharma KG (formerly Dr. Karl Thomae GmbH)), Oprelvekin/Neumega (Genetics Institute), oxaliplatin/Eloxatin (Sanofi Synthelabo), paclitaxel/Taxol (Bristol-Myers Squibb), pamidronate/Aredia (Novartis), pegademase/Adagen (Pegademase Bovine) (Enzon), Pegaspargase/Oncaspar (Enzon, Inc), Pegfilgrastim/Neulasta (Amgen, Inc), pentostatin/Nipent (Parke-Davis Pharmaceutical Co.), pipobroman/Vercyte (Abbott Labs), plicamycin/mithramycin/Mithracin (Pfizer Labs), porfimer sodium/Photofrin (QLT Phototherapeutics Inc.), procarbazine/Matulane (Sigma Tau Pharms), quinacrine/ Atabrine (Abbott Labs), Rasburicase/Elitek (Sanofi-Synthelabo, Inc), Rituximab/Rituxan (Genentech, Inc), Sargramostim/Prokine (Immunex Corp), streptozocin/Zanosar (Pharmacia & Upjohn Company), talc/Sclerosol (Bryan), tamoxifen/Nolvadex (AstraZeneca Pharmaceuticals), temozolomide/Temodar (Schering), teniposide/VM-26/Vumon (Bristol-Myers Squibb), testolactone/Teslac (Bristol-Myers Squibb), thioguanine/6-TG/Thioguanine (GlaxoSmithKline), thiotepa/Thioplex (Lederle Laboratories), topotecan/ Hycamtin (GlaxoSmithKline), topotecan/Hycamtin (GlaxoSmithKline), toremifene/Fareston (Orion Corp), Tositumomab/Bexxar (Corixa Corporation), Trastuzumab/ Herceptin (Genentech, Inc), tretinoin/ATRA/Vesanoid (Roche), Uracil Mustard (Roberts Labs), valrubicin/Valstar (Medeva), vinblastine/Velban (Eli Lilly), vincristine/Oncovin (Eli Lilly), vinorelbine/Navelbine (GlaxoSmithKline), and zoledronate/Zometa (Novartis).

1379. The method for vaccination according to item 1366, wherein the one ore more medicaments can be selected from the group of the immunotherapeutic agents comprising Ributaxin, Herceptin, Quadramet, Panorex, IDEC-Y2B8, BEC2, C225, Oncolym, SMART MI 95, ATRAGEN, Ovarex, Bexxar, LDP-03, ior t6, MDX-210, MDX-11, MDX-22, OV103, 3622W94, anti-VEGF, Zenapax, MDX-220, MDX-447, MELIMMUNE-2, MELIMMUNE-1, CEACIDE, Pretarget, NovoMAb-G2, TNT, Gliomab-H, GNI-250, EMD-72000, LymphoCide, CMA 676, Monopharm-C, 4B5, ior egf.r3, ior c5, BABS, anti-FLK-2, MDX-260, ANA Ab, SMART 1D10 Ab, SMART ABL 364 Ab and ImmuRAIT-CEA, a cytokine or an interferon.

1380. The method for vaccination according to item 1366, wherein the one ore more medicaments can be an antiviral drug such as a Nucleoside/Nucleotide Reverse Transcriptase Inhibitor.

1381. The method for vaccination according to item 1366, wherein the one ore more medicaments can be an antiviral drug such as Non-Nucleoside Reverse Transcriptase Inhibitors.

1382. The method for vaccination according to item 1366, wherein the one ore more medicaments can be a Protease Inhibitor.

1383. The method for vaccination according to item 1366, wherein the one ore more medicaments can be a Fusion or Entry Inhibitor.

1384. The method for vaccination according to item 1366, wherein the one ore more medicaments can be an Integrase Inhibitor.

1385. The method for vaccination according to item 1366, wherein the one ore more medicaments can be selected from the group consisting of lamivudine, Epivir, abacavir, Ziagen, AZT or ZDV, Zidovudine, Retrovir, d4T, Stavudine, Zerit, ddC, Zalcitabine, Hivid, ddl, didanosine, Videx (tablet), Videx EC (capsule), FTC, emtricitabine, Emtriva, TDF, tenofovir, Viread, Epzicom, Kivexa, Trizivir, Combivir, Truvada, Delavirdine, Rescriptor, Efavirenz, Sustiva, Stocrin, Etravirine, Intelence, Nevirapine, Viramune, amprenavir, Agenerase, fosamprenavir, Lexiva, Telzir, Atazanavir, Reyataz, Darunavir, Prezista, Indinavir, Crixivan, lopinavir, ritonavir, Kaletra, Aluvia, nelfinavir, Viracept, ritonavir, Norvir, saquinavir, Fortovase, Invirase, Tipranavir, Aptivus, Enfuvirtide, Fuzeon, maraviroc, Celsentri, Selzentry, raltegravir, Isentress, Atripla, Atazanavir/r, Darunavir/r, Raltegravir, Maraviroc, and Etravirine.

1386. The composition according to items 1-1170, wherein the composition is in solid form.

1387. The composition according to items 1-1170, wherein the composition is in insoluble form.

1388. The composition according to items 1-1170, wherein the composition is in soluble form.

1389. The composition according to items 1-1170, wherein the composition is in suspension.

1390. The composition according to items 1-1170, wherein the composition is sterile.

1391. The composition according to items 1-1170, wherein the composition is prepared as sterile injectables either as liquid solutions or suspensions, aqueous or non-aqueous.

1392. The composition according to items 1-1170, wherein the composition is prepared in solid form suitable for solution, or suspensions, in liquid prior to use.

1393. The composition according to items 1-1170, wherein the composition is emulsified.

1394. The composition according to items 1-1170, wherein the composition is mixed with excipients which are pharmaceutically acceptable such as water, saline, dextrose, glycerol, ethanol or the like and combinations thereof.

1395. The composition according to items 1-1170, wherein the composition comprises minor amounts of auxiliary substances such as wetting or emulsifying agents, pH buffering agents and the like which enhance the effectiveness of the pharmamer.

1396. The composition according to items 1-1170, wherein the composition has a pH within the range of 3.5-8, such as in the range 4.5-7.5, such as in the range 5.5-7, such as in the range 6-7.5, most preferably around 7.3.
1397. The composition according to items 1-1170, wherein the composition has a pH within the range 3.5-7, such as 4-6, such as 5-6, such as 5.3-5.7, such as 5.5.
1398. The composition according to items 1-1170, wherein the composition is for parenteral administration and wherein the composition is dissolved or suspended in sterile aqueous solution, aqueous propylene glycol or sesame or peanut oil.
1399. The composition according to items 1-1170, wherein the composition is a liquid composition comprising liquid phases in addition to and to the exclusion of water such as glycerin, vegetable oils such as cottonseed oil, organic esters such as ethyl oleate, and water-oil emulsions.
1400. The composition according to items 1-1170, wherein the composition comprises one or more suitable pharmaceutical carriers such as inert solid diluents or fillers, sterile aqueous solution and various organic solvents.
1401. The composition according to items 1-1170, wherein the composition comprises one or more solid carriers such as lactose, terra alba, sucrose, cyclodextrin, talc, gelatine, agar, pectin, acacia, magnesium stearate, stearic acid or lower alkyl ethers of cellulose.
1402. The composition according to items 1-1170, wherein the composition comprises one or more liquid carriers such as syrup, peanut oil, olive oil, phospholipids, fatty acids, fatty acid amines, polyoxyethylene or water.
1403. The composition according to items 1-1170, wherein the composition is administered by nasal aerosol or inhalation and wherein the composition is prepared for example, as solutions in saline, employing benzyl alcohol or other suitable preservatives, absorption promoters to enhance bioavailability, employing fluorocarbons, and/or employing other solubilizing or dispersing agents.
1404. The composition according to items 1-1170, wherein the composition is prepared in unit dosage form.
1405. The composition according to items 1-1170, wherein the composition is prepared as a lyophilisate.
1406. The composition according to items 1-1170, wherein the composition comprises a solvent.
1407. The composition according to items 1-1170, wherein the composition is prepared as an injectable solution.
1408. The composition according to items 1-1170, wherein the composition is prepared as a dispersion.
1409. The composition according to items 1-1170, wherein the composition is prepared as a suspension.
1410. The composition according to items 1-1170, wherein the composition is prepared as a emulsion.
1411. The composition according to items 1-1170, wherein the composition is prepared as a sterile powders to be reconstituted in sterile injectable solutions or dispersions prior to use.
1412. The composition according to items 1-1170, wherein the composition is prepared as suppositories.
1413. The composition according to items 1-1170, wherein the composition is prepared as a spray.
1414. The composition according to items 1-1170, wherein the composition is prepared as an ointment, creme, or gel.
1415. The composition according to items 1-1170, wherein the composition is prepared as an inhalant.
1416. The composition according to items 1-1170, wherein the composition is prepared as a dermal patch.
1417. The composition according to items 1-1170, wherein the composition is prepared as an implant.
1418. The composition according to items 1-1170, wherein the composition is prepared as a pill, tablet, lozenge or capsule.
1419. The composition according to items 1-1170, wherein the composition is formulated for aerosol administration, particularly to the respiratory tract and including intranasal administration.
1420. The composition according to items 1-1170, wherein the composition is prepared in a pressurized pack with a suitable propellant such as a chlorofluorocarbon (CFC) for example dichlorodifluoromethane, trichlorofluoromethane, or dichlorotetrafluoroethane, carbon dioxide or other suitable gas.
1421. The composition according to items 1-1170, wherein the composition is a powder comprising a powder base such as lactose, starch, starch derivatives such as hydroxypropylmethyl cellulose and polyvinylpyrrolidine (PVP).
1422. The composition according to items 1-1170, wherein the composition is prepared as a gel.
1423. The composition according to items 1-1170, wherein the composition is prepared as a capsules or cartridges of e.g., gelatin or blister packs.
1424. The composition according to items 1-1170, wherein the composition is prepared as an aerosol prepared, for example, as solutions in saline, employing benzyl alcohol or other suitable preservatives, absorption promoters to enhance bioavailability, employing fluorocarbons, and/or employing other solubilizing or dispersing agents.
1425. The composition according to items 1-1170, wherein the composition is formulated for parenteral administration.
1426. The composition according to items 1-1170, wherein the composition is formulated for intravenous administration.
1427. The composition according to items 1-1170, wherein the composition is formulated for intramuscular administration.
1428. The composition according to items 1-1170, wherein the composition is formulated for intraarticular formulation.
1429. The composition according to items 1-1170, wherein the composition is formulated for subcutaneous administration.
1430. The composition according to items 1-1170, wherein the composition is formulated for intradermal administration.
1431. The composition according to items 1-1170, wherein the composition is formulated for epicutantous/transdermal administration.
1432. The composition according to items 1-1170, wherein the composition is formulated for intra-peritoneal administration.
1433. The composition according to items 1-1170, wherein the composition is formulated for infusion.
1434. The composition according to items 1-1170, wherein the composition is formulated for oral administration.
1435. The composition according to items 1-1170, wherein the composition is formulated for nasal administration.
1436. The composition according to items 1-1170, wherein the composition is formulated for rectal administration.
1437. The composition according to items 1-1170, wherein the composition is formulated for vaginal administration.
1438. The composition according to items 1-1170, wherein the composition is formulated for topic administration.
1439. The composition according to items 1-1170, wherein the composition comprises one or more pharmamers immobilised onto a solid or semi-solid support such as particles, beads, biodegradable particles, sheets, gels, filters, membranes, fibres, capillaries, needles, microtitre strips, tubes, plates or wells, combs, pipette tips, micro arrays, and chips.
1440. The composition according to items 1-1170, wherein the composition comprises one or more pharmamers immobilised onto particles and beads, which are polymeric, magnetic or superparamagnetic.
1441. The composition according to items 1-1170, wherein the composition comprises one or more pharmamers that target specific MHC recognising cells.
1442. The composition according to items 1-1170, wherein the composition comprises one or more pharmamers capable of induction of a response in specific target MHC recognising cells by addressing receptors on such cells.
1443. The composition according to item 882, wherein the one or more biological active molecules and the one or more multimerization domain by a mechanism comprising biotinylation.
1444. The composition according to item 1443, where the mechanism comprises Streptavidin and/or Avidin and Biotin.
1445. The composition according to item 1443, where the mechanism comprises enzymatic biotinylation.
1446. The composition according to item 1443, where the mechanism comprises non-enzymatic biotinylation.
1447. The composition according to item 882, wherein the one or more biological active molecules are directly or indirectly bound to the multimerization domain.
1448. The composition according to item 882, wherein the one or more biological active molecules are not directly or indirectly bound to the multimerization domain.

EXAMPLES

Example 1: Example of a Vaccine Consisting of Pharmamers for Vaccination Against HIV/SIV in Monkeys The vaccine is composed of a Dextran (270 kDa) multimerisation domain that has been derivatized by attaching Strepavidin (on average 8.6 Strepavidin molecules/Dextran molecule). Attached to the streptavidin molecules are Simian MHC class 1 molecules, either Mamu-A*01(CTPYDINQM) (SEQ ID NO 9569), Mamu-A*08(KPCVKLTP) (SEQ ID NO 9570), or Mamu-B*17(IRFPKTFGW) (SEQ ID NO 9571). Attachment is done by non-covalent interaction via a COOH-terminal Biotin molecule on the recombinant Mamu heavy chain and the streptavidin molecules on the Dextran multimerisation domain. Likewise are biotinylated synthetic Mamu class 2 peptides representing Mamu-DQB1*0601(EFVRFDSAVGEYRAV) (SEQ ID NO 9572); Mamu-DQB1*1808(EFVGFDSYLGVYRPV) (SEQ ID NO 9573); Mamu-DRB*W201 (TREDILERERAQVDTFY) (SEQ ID NO 9574) and recombinant HSP70pep3Bio fragments (a biotinylated HSP70 fragment spanning amino acid residues 359-609) attached to strepavidin sites.

The Mamu class 1 bound peptides represents the proteins, HIV-Gag (CTPYDINQM) (SEQ ID NO 9569), HIV-Env (KPCVKLTP) (SEQ ID NO9570) and Siv Nef (IRFPKTFGW) (SEQ ID NO 9571).

A single full dose of the final vaccine corresponds to, 100 □g of each MHC class 1 molecule; 4.6 µg of each MHC class 2 peptide; 3×25.9 µg HSP70pep3Bio and 3×162.5 □g dextran (corresponding to a total of approx 260 µg pharmamer/kg body weight for a monkey of 3.5 kg) and consist of a 1:1:1 mixture of the following three pharmamers:
Pharmamer 1:
Mamu-A*01(CTPYDINQM) (SEQ ID NO 9569)+Mamu-DQB1*0601 (EFVRFDSAVGEYRAV) (SEQ ID NO 9572) class 2 peptide+HSP70pep3Bio+Dextran multimerisation domain, in the molar ratio 10/10/4/1
Pharmamer 2:
Mamu-A*08 (KPCVKLTP) (SEQ ID NO 9570)+Mamu-DQB1*1808 (EFVGFDSYLGVYRPV) (SEQ ID NO 9573) class 2 peptide+HSP70pep3Bio+Dextran multimerisation domain, in the molar ratio 10/10/4/1
Pharmamer 3:
Mamu-B*17(IRFPKTFGW) (SEQ ID NO 9571)+Mamu-DRB*W201 (TREDILERERAQVDTFY) (SEQ ID NO 9574) class 2 peptide+HSP70pep3Bio+Dextran multimerisation domain, in the molar ratio 10/10/4/1
Administration:
The pharmamer mix is absorbed into the adjuvant Alhydrogel (Aluminiumhydroxide gel) as specified by the manufacturer and administered as intramuscular injections at time points 0, 4, 8, and 16 weeks such that a full dose is given at 0 weeks and half-full dose at 4, 8, and 16 weeks.

Example 2: Example of a Vaccine Consisting of Pharmamers for Vaccination Against HIV/SIV in Monkeys The vaccine is composed of a Dextran (270 kDa) multimerisation domain that has been derivatized by attaching Strepavidin (on average 8.6 Strepavidin molecules/Dextran molecule). Attached to the Dextran-streptavidin multimerisation domain are Simian MHC class 1 molecules, either Mamu-A*01(CTPYDINQM) (SEQ ID NO 9569), Mamu-A*08(KPCVKLTP) (SEQ ID NO 9570), or Mamu-B*17 (IRFPKTFGW) (SEQ ID NO 9571). Attachment is done via a COOH-terminal Biotin molecule on the recombinant Mamu heavy chain to the streptavidin molecules on the multimerisation domain. Likewise are biotinylated synthetic Mamu class 2 peptides representing Mamu-DQB1*0601 (EFVRFDSAVGEYRAV) (SEQ ID NO 9572); Mamu-DQB1*1808 (EFVGFDSYLGVYRPV) (SEQ ID NO 9573); Mamu-DRB*W201 (TREDILERERAQVDTFY) (SEQ ID NO 9574) and recombinant HSP70pep3Bio fragments (a biotinylated HSP70 fragment spanning amino acid residues 359-609) attached to strepavidin sites. Further to these molecules are recombinant HIV-1gp140 trimer and SIVp27 attached by Biotin-Strepavidin binding.

The Mamu class 1 bound peptides represents the proteins, HIV-Gag (CTPYDINQM) (SEQ ID NO 9569); HIV-Env (KPCVKLTP) (SEQ ID NO 9570); and Siv Nef (IRFPKTFGW) (SEQ ID NO 9571).

A single full dose of the final vaccine corresponds to, 100 □g of each MHC class 1 molecule; 4.6 µg of each MHC class 2 peptide; 4×25.9 ug HSP70pep3Bio; 37.1 µg Sivp27; 152.8 µg HIV-1gp140trimer and 4×162.7 µg dextran (corresponding to a total of approx 360 µg pharmamer/kg body weight for a monkey of 3.5 kg) and consist of a 1:1:1:1 mixture of the following four pharmamers:
Pharmamer 1:
Mamu-A*01(CTPYDINQM) (SEQ ID NO 9569)+Mamu-DQB1*0601 (EFVRFDSAVGEYRAV) (SEQ ID NO 9572) class 2 peptide+HSP70pep3Bio+Dextran multimerisation domain, in the molar ratio 10/10/4/1
Pharmamer 2:
Mamu-A*08 (KPCVKLTP) (SEQ ID NO 9570)+Mamu-DQB1*1808 (EFVGFDSYLGVYRPV) (SEQ ID NO 9573) class 2 peptide+HSP70pep3Bio+Dextran multimerisation domain, in the molar ratio 10/10/4/1
Pharmamer 3:

Mamu-B*17(IRFPKTFGW) (SEQ ID NO 9571)+Mamu-DRB*W201 (TREDILERERAQVDTFY) (SEQ ID NO 9574) class 2 peptide+HSP70pep3Bio+Dextran multimerisation domain, in the molar ratio 10/10/4/1
Pharmamer 4:
  Sivp27+HIV-1gp140trimer+HSP70pep3Bio+Dextran multimerisation domain, in the molar ratio 3/10/4
Administration:
  The pharmamer mix is absorbed into the adjuvant Alhydrogel (Aluminiumhydroxide gel) as specified by the manufacturer and administered as intramuscular injections at time points 0, 4, 8, and 16 weeks such that a full dose is given at 0 weeks and half-full dose at 4, 8, and 16 weeks.

Example 3: Example of a Vaccine Consisting of Pharmamers for Vaccination Against HIV/SIV in Monkeys The vaccine is composed of a Dextran (270 kDa) multimerisation domain that has been derivatized by attaching Streptavidin (on average 8.6 Streptavidin molecules/Dextran molecule). Attached to the multimerisation domain are Human MHC class 1 molecules, either HLA-A*0101(IVDCLTEMY) (SEQ ID NO 9575), HLA-A*0201 (GLIQLVEGV) (SEQ ID NO 9576), HLA-A*0301(RIAAWMATY) (SEQ ID NO 9577), HLA-A*1 101 (IVTDFSVIK) (SEQ ID NO 9578). Attachment is done via a COOH-terminal Biotin molecule on the recombinant HLA heavy chain to the streptavidin molecules on the multimerisation domain. Likewise are biotinylated recombinant HLA class 2 protein HLA-DR*0401 and recombinant HSP70pep3Bio fragments (a biotinylated HSP70 fragment spanning amino acid residues 359-609) attached to streptavidin sites.

The HLA class 1 bound peptides represents the proteins, USP9Y, ubiquitin specific protease 9 (IVDCLTEMY) (SEQ ID NO 9575); TRAG-3_4 (GLIQLVEGV) (SEQ ID NO 9576); BCL2L1 (RIAAWMATY) (SEQ ID NO 9577); EBV EBNA3B (IVTDFSVIK) (SEQ ID NO 9578). The HLA class 2 complex is produced without a peptide in the binding groove but it cannot be excluded that the groove may contain unknown peptides derived from either serum or the S2 production cells.
Administration:
  A single full dose of the final vaccine corresponds to, 100 □g of each HLA class 1 molecule; 113.5 µg of HLA class 2; 3×25.8 µg HSP70pep3Bio and 3×162.2 µg dextran (corresponding to a total of approx 300 µg pharmamer/kg body weight for a monkey of 3.5 kg) and consist of a 1:1:1 mixture of the following three pharmamers:
Pharmamer 5:
  HLA-A*0101(IVDCLTEMY) (SEQ ID NO 9575)+HLA-DR*0401 class 2+HSP70pep3Bio+Dextran multimerisation domain, in the molar ratio 10/10/4/1
Pharmamer 6:
  HLA-A*0201(GLIQLVEGV) (SEQ ID NO 9576)+HLA-A*0301(RIAAWMATY) (SEQ ID NO 9577)+HSP70pep3Bio+Dextran multimerisation domain, in the molar ratio 10/10/4/1
Pharmamer 7:
  HLA-A*1101(IVTDFSVIK) (SEQ ID NO 9578)+HSP70pep3Bio+Dextran multimerisation domain, in the molar ratio 10/4/1
Administration:
  The pharmamer mix is emulsified with the adjuvant Titermax Gold as specified by the manufacturer and administered as intramuscular injections at time points 0, 4, 8, and 16 weeks such that a full dose is given at 0 weeks and half-full dose at 4, 8, and 16 weeks.

Example 4: Example of a Vaccine Consisting of Pharmamers for Vaccination Against HIV/SIV in Monkeys The vaccine is composed of a Dextran (270 kDa) multimerisation domain that has been derivatized by attaching Streptavidin (on average 8.6 Streptavidin molecules/Dextran molecule). Attached to the multimerisation domain are Human MHC class 1 molecules, either HLA-A*0101(IVDCLTEMY) (SEQ ID NO 9575), HLA-A*0201 (GLIQLVEGV) (SEQ ID NO 9576), HLA-A*0301(RIAAWMATY) (SEQ ID NO 9577), or HLA-A*1 101 (IVTDFSVIK) (SEQ ID NO 9578). Attachment is done via a COOH-terminal Biotin molecule on the recombinant HLA heavy chain to the streptavidin molecules on the multimerisation domain. Likewise are biotinylated recombinant HLA class 2 protein HLA-DR*0401 and recombinant HSP70pep3Bio fragments (a biotinylated HSP70 fragment spanning amino acid residues 359-609) attached to streptavidin sites. Further to these molecules are recombinant HIV-1gp140 trimer and SIVp27 attached by Biotin-Streptavidin binding.

The HLA class 1 bound peptides represents the proteins, USP9Y, ubiquitin specific protease 9 (IVDCLTEMY) (SEQ ID NO 9575); TRAG-3_4 (GLIQLVEGV) (SEQ ID NO 9576); BCL2L1 (RIAAWMATY) (SEQ ID NO 9577); EBV EBNA3B (IVTDFSVIK) (SEQ ID NO 9578). The HLA class 2 complex is produced without a peptide in the binding groove but it cannot be excluded that the groove may contain unknown peptides derived from either serum or the S2 production cells.

A single full dose of the final vaccine corresponds to, 100 µg of each HLA class 1 molecule; 113.5 µg of HLA class 2; 4×25.9 ug HSP70pep3Bio; 37.1 µg Sivp27; 152.8 µg HIV-1gp140trimer and 4×162.7 µg dextran (corresponding to a total of approx 415 µg pharmamer/kg body weight for a monkey of 3.5 kg) and consist of a 1:1:1:1 mixture of the following four pharmamers:
Pharmamer 5:
  HLA-A*0101(IVDCLTEMY) (SEQ ID NO 9575)+HLA-DR*0401 class 2+HSP70pep3Bio+Dextran multimerisation domain, in the molar ratio 10/10/4/1
Pharmamer 6:
  HLA-A*0201(GLIQLVEGV) (SEQ ID NO 9576)+HLA-A*0301(RIAAWMATY) (SEQ ID NO 9577)+HSP70pep3Bio+Dextran multimerisation domain, in the molar ratio 10/10/4/1
Pharmamer 7:
  HLA-A*1101 (IVTDFSVIK) (SEQ ID NO 9578)+HSP70pep3Bio+Dextran multimerisation domain, in the molar ratio 10/4/1
Pharmamer 4:
  Sivp27+HIV-1gp140trimer+HSP70pep3Bio+Dextran multimerisation domain, in the molar ratio 3/10/4
Administration:
  The pharmamer mix is emulsified with the adjuvant Titermax Gold as specified by the manufacturer and administered as intramuscular injections at time points 0, 4, 8, and 16 weeks such that a full dose is given at 0 weeks and half-full dose at 4, 8, and 16 weeks.

Example 5: Example of a Vaccine Consisting of Pharmamers for Vaccination Against HIV/SIV in Monkeys The vaccine is composed of a Dextran (270 kDa) multimerisation domain that has been derivatized by attaching Streptavidin (on average 8.6 Streptavidin molecules/Dextran molecule). Attached to the multimerisation domain are Simian MHC class 1 molecules, either Mamu-A*01(CTPYDINQM) (SEQ ID NO 9569), Mamu-A*08(KPCVKLTP) (SEQ ID NO 9570), or Mamu-B*17(IRFPKTFGW) (SEQ ID NO 9571). Attachment is done via a COOH-terminal Biotin molecule on the recombinant Mamu heavy chain to the streptavidin molecules on the multimerisation domain. Likewise are biotinylated recombinant HSP70pep3Bio-CCR5-tripeptide fragment, a biotinylated fusion protein consisting of the HSP70 fragment spanning amino acid residues 359-609 plus the antigenic CCR5 loops, N-terminal loop, Loop1 and Loop2, attached to streptavidin sites.

The Mamu class 1 bound peptides represents the proteins, HIV-Gag (CTPYDINQM) (SEQ ID NO 9569), HIV-Env (KPCVKLTP) (SEQ ID NO 9570) and Siv Nef (IRFPKTFGW) (SEQ ID NO 9571). The CCR5 peptides representing the three antigenic loops are, N-terminal (MNYQVSSPIYNINYYTSEPC) (SEQ ID NO 9579); Loop1 (HYAAAQWNFGNTMCQ) (SEQ ID NO 9580); Loop2 (YSSHFPYSQYQFWKNFQTLK) (SEQ ID NO 9581).

A single full dose of the final vaccine corresponds to, 100 □g of each MHC class 1 molecule; 3×126 □g HSP70pep3Bio-CCR5-tripeptide and 3×125 □g dextran (corresponding to a total of approx 300 □g pharmamer/kg body weight for a monkey of 3.5 kg) and consist of a 1:1:1 mixture of the following three pharmamers Pharmamer 8:
Mamu-A*01(CTPYDINQM) (SEQ ID NO 9569)+HSP70pep3Bio-CCR5-tripeptide+Dextran multimerisation domain, in the molar ratio 13/10/1

Pharmamer 9:
Mamu-A*08 (KPCVKLTP) (SEQ ID NO 9570)+HSP70pep3Bio-CCR5-tripeptide+Dextran multimerisation domain, in the molar ratio 13/10/1

Pharmamer 10:
Mamu-B*17(IRFPKTFGW) (SEQ ID NO 9571)+HSP70pep3Bio-CCR5-tripeptide+Dextran multimerisation domain, in the molar ratio 13/10/1

Administration:
The pharmamer mix is administered as intramuscular injections at time points 0, 2, 4, 6, 8, 10, 12 and 14 weeks such that a full dose is given at each time point.

Example 6

This is an example of generation of a pharmamers that can be used in a vaccine composition for treatment of SIV/HIV.

4 different vaccine compositions were generated comprising between 1-4 pharmamers whereto 3-5 different biological active molecules were attached. The multimerization domain in all pharmamers was Streptavidin (SA) coupled Dextran (270 kDa) and the biologically active molecules were attached to the SA-Dextran backbone by a non-covalent interaction between SA and biotin on the biologically active molecules. In the following generation of the individual components in the pharmamers are described:

Generation of Multimerization Domain:
Dextran270 were coupled with SA using the following procedure. Divinyl sulfone acid activated Dextran270 were mixed with SA in a molar ratio of 1:13 (Dextran270:SA) in buffer (0.025 M NaHCO$_3$, 0.1 M NaCl) for 2 hours at 40° C. The final concentration of Dextran270 was 6 uM. Then the reaction was stopped by adding 10 vol % 0.165 M Cystein, incubation for 30 minutes at 40° C. Excess SA was removed by gelfiltration on a Superdex 200-column and the buffer exchanged to 0,1M NaCl; 10 mM CHES; pH 9.0.

The final product had a concentration of 0.65 mg/ml and 8.6 SA molecules per Dextran molecule in average.

Generation of Biotinylated MHC I-Peptide Complexes:
Four different biotinylated MHC I-peptide complexes were generated:
HLA-A*0101(IVDCLTEMY) SEQ ID NO 9588), HLA-A*1101 (IVTDFSVIK) SEQ ID NO 9589), HLA-A*0201 (GLIQLVEGV) SEQ ID NO 9590, HLA-A*0301(RIAAWMATY) SEQ ID NO 9591.

The protein coding sequences minus the signal peptide and transmembrane regions of all of the 4 human MHC class 1 heavy chain molecules were obtained from GenBank and the sequence backtranslated according to *E. coli* codon usage using www.entelechon.com. The gene was synthesized by PCR using 10 overlapping DNA primers (DNA Technology, Denmark) and KOD polymerase (EMD Chemicals, Novagen). Sequence was verified by repeated DNA sequencing (MWG Biotech, Ebersberg, Germany) and base errors introduced were corrected using Quick Change multi site-directed mutagenesis kit (Stratagene, La Jolla, Calif.) before cloning in pGarboczi (Garboczi et al 1992). Human beta2Microblulin (β2m) (GenBank acc #CAG33347.1) was acquired and cloned. Recombinant MHC 1 heavy chain and β2m protein was produces by fermentation, isolated and purified by column chromatography.

MHC-peptide complexes was generated by in vitro refolding of heavy chain, β2m and peptide in a buffer containing reduced and oxidized glutathione. By incubation in this buffer a non-covalent complex between Heavy Chain, β2m and peptide was formed. Heavy chain and β2m was expressed as inclusion bodies in *E. coli* prior to in vitro refolding following standard procedures as described in Garboczi et al., (1996), Nature 384, 134-141. Following refolding the MHC complexes was biotinylated using BirA enzyme able to biotinylate a specific amino acid residue in a recognition sequence fused to the C-terminal of the Heavy Chain by genetic fusion. Monomer MHC complexes was then purified by size exclusion chromatography.

1. 200 ml of refolding buffer (100 mM Tris, 400 mM L-arginin-HCL, 2 mM NaEDTA, 0.5 mM oxidized Gluthathione, 5 mM reduced Glutathione, pH 8.0) was supplied with protease inhibitors PMSF (phenylmethylsulphonyl fluoride), Pepstatin A and Leupeptin (to a final concentration of 1 mM, 1 mg/l and 1 mg/l, respectively). The refolding buffer was placed at 10° C. on a stirrer.
2. 12 mg of peptide was dissolved in DMSO or another suitable solvent (300-500 µl), and added drop-wise to the refolding buffer at vigorous stirring.
3. 4.4 mg of human Light Chain β2m was added drop-wise to the refolding buffer at vigorous stirring.
4. 6.2 mg of Heavy Chain (supplied with DTT to a concentration of 0.1 mM) was added drop-wise to the refolding buffer at vigorous stirring.
5. The folding reaction was placed at 10° C. at slow stirring for 4-8 hours.
6. After 4-8 hours, step 3 and 4 was repeated and the folding reaction is placed at 10° C. at slow stirring O/N.
7. Step 3 and 4 was repeated, and the folding reaction is placed at 10° C. at slow stirring for 6-8 hours. Optionally, steps 5-7 may be done in less time, e.g. a total of 0.5-5 hours.
8. After 6-8 hours the folding reaction was filtrated through a 0.2 µm filter to remove aggregates.
9. The folding reaction was concentrated O/N at 10° C. shaking gently in a suitable concentrator with a 5000 mw cut-off filter. The folding reaction was concentrated to approximately 5-10 ml. (Optionally the filtrate can be stored at 4° C. and reused for another folding with the same peptide and heavy chain.)

10. The concentrated folding reaction was buffer-exchanged at least 8 times, into a MHC-buffer (20 mM Tris-HCl, 50 mM NaCl, pH 8.0) and concentrated (at 10° C. in a suitable concentrator with a 5000 mw cut-off filter) down to approximately 1 ml.
11. The heavy chain part of the MHC-complex was biotinylated by mixing the following components: approximately 1000 μl folded MHC-complex, 100 μl each of Biomix-A, Biomix-B and d-Biotin (all 3 from Biotin Protein Ligase Kit from Avidity, 10 μl birA enzyme (3 mg/ml, from Biotin Protein Ligase Kit from Avidity, 0.5 μl Pepstatin A (2 mg/ml) and 0.5 μl Leupeptin (2 mg/ml). The above was gently mixed and incubated O/N at room temperature.
12. The biotinylated and folded MHC-complex solution was centrifuged for 5 min. at 1700×g, room temperature.
13. Correctly folded MHC-complex was separated and purified from excess biotin, excess β2m, excess heavy chain and aggregates thereof, by size exclusion chromatography on a column that separates proteins in the 10-100 kDa range. Correctly folded monomer MHC-complex was eluted with a MHC-buffer (20 mM Tris-HCl, 50 mM NaCl, pH 8.0). The elution profile consisted of 4 peaks, corresponding to aggregated Heavy Chain, correctly folded monomer MHC-complex, β2m and excess biotin and peptide.
14. Fractions containing the folded MHC-complex were pooled and concentrated to approximately 1 ml in a suitable concentrator with a 5000 mw cut-off filter. The protein-concentration was estimated from its absorption at 280 nm.
15. The grade of biotinylation was analyzed by a SDS PAGE SHIFT-assay with Streptavidin and correct folding was confirmed by ELISA, using the antibody W6/32 that recognizes correctly folded MHC-peptide complex.

Generation of Biotinylated DR4 Molecules:

DR0401-leucine zipper-biotinylation site-expression vectors were made using the PCR-mediated splicing overlap technique together with the plasmid pUChsneo, which carries the neomycin resistance marker, were co-transfected into Schneider cells S-2 by standard calcium phosphate transfection techniques. The DR*0401 (DR4) molecules were purified by affinity chromatography using L243 antibody as described previously (Stern and Wiley 1992). The DR4 molecules were biotinylated using BirA enzyme and a standard protocol following a standard biotinylation protocol provided by the manufacturer Construction, Purification and Production of Trimeric HIVgp140 (YU2gp140) (SEQ ID NO 9583).

PCR Cloning was carried out by inserting the Avi tag in the YU2gp140 Foldon trimer; two sets of PCR overlapping primers were designed. The first set of primers was used with YU2 gp140 foldon construct and to amplify the portions of YU2 gp140 region from BamH1 site through the foldon trimerization motif, His tag and some seq. of Avi tag followed by the stop codon. The other set amplified the His Tag followed by Avi tag seq. and the rev primer amplified the Hind III site, a stop codon and the remaining of the Avi tag. After one round of amplification both the reaction were mixed and the PCR was performed using the Fw primer from first set and the rev primer from second set. PCR amplified product was run on 1% agarose gel at 100V constant and eluted from the gel using standard procedure. The amplified fragment was digested with BamH1 followed by Hind III. The vector DNA was similarly sequentially digested with the following enzymes and a ligation reaction was performed using the Rapid ligation kit from Roche. The Top10 competent cells (Invitrogen) were transformed with the 5 ul of ligation mix and then plated on Carbenicillin containing plates. 10 colonies were picked up and inoculated in LB medium containing the Carbenecillin and Mini prep was performed using Qiagen kit. The DNA was sent for seq. to ACGT, Inc. using YU2 gp140 Fw primer and seq analysis was performed in the Vector NTI program. The 293 freestyle cells were obtained from Invitrogen and were maintained in serum-free media. The transient transfection was performed when cells reached a density of 2-3×10^6/ml and dilute it to 1.2×10^6/ml with fresh medium in 1 L batches using 293 fectin reagent from Invitrogen. The transfection grade DNA was obtained from Aldeveron and the transfection was set using standard protocol. After 4 days in culture the supernatant was collected by centrifuging cells in 250 ml conical tubes at 1500 rpm for 30'. The protease inhibitors tablets from Roche were added (1 tablet/50 ml of sup) and the supernatant was centrifuged using 0.2 um filters. The supenatant was checked by immuno-precipitation with monoclonal antibodies such as b12 for protein expression and then loaded onto the Lentil Lectin (GE Health Care) column overnight (FIG. 1B). The column was washed with at least 10V PBS with 0.5M NaCl and the glycoproteins were eluted with 1M-α D Methyl Mannopyranoside by rocking the column with 10 volumes of elution buffer. The proteins from the first column were loaded onto Ni column and further eluted with 300 mM—imidazole phosphate buffer. The protein was concentrated by using 30 kDa Millipore concentrators and buffer exchanged with PBS. The total amount of the protein was determined using Spectrophotometer 3000 by OD 280 nM. Trimeric HIVgp140 was biotinylated using BirA enzyme following a standard biotinylation protocol provided by the manufacturer.

Generation of SIVp27 (SEQ ID NO 9584)

Recombinant SIV 27gag (SIVp27) was expressed as pGEX-3x glutathione S-transferase fusion protein from *Escherichia coli* as previously described (Mills et al 1992). Recombinant proteins were reconstituted at 2 mg/ml in PBS. A 10 fold molar excess of Sulpho-NHS-LC-LC Biotin (Pierce UK), at ~10 mM in PBS, was added to the protein solutions and incubated at room temperature for 30 minutes. Excess biotin was removed by dialysis against sterile PBS overnight at 4° C. The biotinylated proteins were then incubated with 2 rounds of polymyxin B beads to remove LPS (GE Healthcare, UK). Verification of biotinylation was performed as follows. The proteins were analysed by SDS-PAGE followed by Coomaasie Blue staining and western blotting onto nitrocellulose. The nitrocellulose blots were probed directly with avidin conjugated to horse radish peroxidase (ExrAvidin, Sigma-Aldrich UK) and developed with 3 Amino 9 ethylcarbazole tablets and hydrogen peroxide in 50 mM Acetate buffer pH 5.0 (Sigma-Aldrich, UK). The proteins were >90% biotinylated.

Generation of C-Terminal Fragment of HSP70

The C-terminal fragment of *M. tuberculosis* HSP70 (359-609) (SEQ ID NO 9582) was subcloned to enable in vitro biotinylation. A primer of 76 bases for PCR was designed that allows fusion of the recognition site for in vivo biotinylation in *E. coli* to the C-terminal end of $HSP_{359-609}$. Together with a forward cloning primer the $HSP_{359-609}$ fusion gene was amplified and after restriction with NdeI and XhoI inserted into the expression vector pET26. The resulting plasmid pLEXWO167-4 was transformed into *E.* coli BL21 (DE3). This strain was used for production of biomass. The insert of plasmid pLEXWO167-4 was confirmed by sequencing.

For rapid purification metal chelate chromatography $HSP_{359-609}$ was fused to a 6-fold histidine tag. The $HSP_{359-609}$ gene was again excised from plasmid pLEXWO167-4 using restriction endonucleases NdeI and XhoI and inserted into pET28 which provides the sequence for the N-terminal histidine tag. The resulting plasmid pLEXWO175-4 was transformed into E. coli BL21 (DE3). This strain was used for production of biomass of biotinylated $HSP_{359-609}$ with N-terminal histidine tag. 2. Biomass derived from BL21 (DE3) [pLEXWO175-4] was disrupted using sonification and homogenization. The supernatant after centrifugation underwent metal chelate affinity chromatography. To achieve a higher purity the protein underwent two further purification steps, by anion exchange and size exclusion chromatography. The highly purified N-his $HSP_{359}$-$6_{09}$-bio (40 mg) was subjected to final quality control and a Western blot.

Linking the Biologically Active Molecules to Multimerization Domain

The following pharmamer constructs were made:
1) Dextran270+HLA-A*0101(IVDCLTEMY) (SEQ ID NO 9588)+DR4+HSP70 (molar ratio 1:10:10:4)
2) Dextran270+HLA-A*0201(GLIQLVEGV) (SEQ ID NO 9590)+HLA-A*0301(RIAAWMATY) (SEQ ID NO 9591)+HSP70 (molar ratio 1:10:10:4)
3) Dextran270+HLA-A*1101 (IVTDFSVIK) SEQ ID NO 9589)+HSP70 (molar ratio 1:10:4)
4) Dextran270+HIVgp140+Sivp27+HSP70 (molar ratio 1:3:10:4)

The 4 constructs were made by mixing Dextran270 with the above said biotinylated biological molecules (HLA I-peptide complexes, DR4 molecules, trimeric HIVgp140, SIVp27 and/or HSP70 (359-609)) in molar ratios as described. The final concentration of Dextran was 0.014 M.

These pharmamers may be used in a composition for vaccination of individuals with HIV or vaccination of healthy individuals for preventing infection with HIV.

Example 7

This is an example of how pharmamer vaccine compositions comprising one or more of the pharmamers described in example 6 are used for prophylactic vaccination/immunization of rhesus macaques later challenged with simian HIV.

Immunization of Macaques

Thirty-eight female rhesus macaques (*Macaca mulatta*) of Chinese origin, 3-5 years old at the start of the study, were housed in the Astrid Fagraeus laboratory at the Swedish Institute for Infectious Disease Control. Housing and care procedures were in compliance with the provisions and general guidelines of the Swedish Animal Welfare Agency. All procedures were approved by the Local Ethical Committee on Animal Experiments. Animals were housed in pairs in 4 m³ cages, enriched to allow expression of physiological and behavioural needs. They were habituated to the housing conditions for more than 6 weeks before the start of the experiment, and subjected to positive reinforcement training to reduce the stress associated with experimental procedures. All immunizations and blood sampling were performed under sedation with ketamine 10 mg/kg i.m. (Ketaminol 100 mg/ml, Intervet, Sweden). Macaques were weighed and examined for swelling of lymphnodes and spleen at each immunization or sampling occasion. Before entering the study, all animals were confirmed to be negative for simian immunodeficiency virus (SIV), simian T-cell lymphotropic virus and simian retrovirus type D.

32 of the macaques were divided into 4 groups of eight animals and immunized SC at weeks 0-4-8 and 16 (FIG. 3A) with vaccine compositions comprising one or more of the pharmamers described in example 6. The different groups were immunized with different pharmamer vaccine compositions as described in FIG. 3B. The constituents and concentrations of each of the 4 pharmamers used in a single dose are shown in FIG. 3C. Animals in groups 1-3 received a full vaccine dose at the first immunization and half doses at the following immunizations. The vaccines for groups 1-3 were given subcutaneously (s.c.) formulated as an emulsion with the TiterMax® Gold adjuvant (0.5 mL/full dose; Sigma-Aldrich, St Louis, Mo., USA). An additional six animals (group 5) received the same vaccine as group 2, but intramuscularly (i.m.) without TiterMax® Gold (FIG. 3B), and full vaccine doses at all immunizations.

SHIV Challenge

A SHIV-SF162P4 stock was expanded in the human T cell line C8166-CCR5, expressing HLA-A*01 and -DRB1*04. This T cell line expanded stock was designated SHIV-SF162P4/C. A limited in vivo titration was performed in nine rhesus macaques of Chinese origin. 3/3, 2/3 and 0/3 animals became infected after intravenuous (i.v.) inoculation with 1 ml of a 1/1,000, a 1/100,000 and a 1/1,000,000 dilution, respectively. The approximate animal infectious $dose_{50}$ ($AID_{50}$) was determined by Reed-Muench to be $1.8 \times 10^5$/mL. At week 20 group 1, 2, 3 and 5 animals plus eight naïve animals (group 4) were challenged i.v. with 1 mL of a 1/10,000 dilution (corresponding to 18 $MID_{50}$, $5.8 \times 10^4$ RNA equivalents/ml, and 22.4 and 0.3 TCID50 as measured on C8166-CCR5 cells and rhesus PBMC, respectively) of SHIV-SF162P4/C.

Measurement of Viral Load Post Viral Challenge

Viral load was measured in the animals up to 10 weeks apost SHIV challenge with weekly intervals. The viral load was measured by measuring reverse trancriptase activity in plasma using the ExaVir® Load version 2 kit (Cavidi Tech AB, Uppsala, Sweden) as described by Kiepla et al. Nat. Med. (2007) 13:46-532 and translated to RNA equivalents/ml.

The peak viral load (2-3 weeks post-challenge) was significantly lower only in group 2 macaques (p<0.05), which were immunized with all vaccine components, compared with the unimmunized animals (FIG. 4A). Group 1 and 5 macaques showed peak viral load at week 3 after infection (in 6/8 and 4/6, respectively), similar to those in the control group 4 (6/8). Group 3 animals however, reached a peak viral load 2 weeks after infection (7/8 animals), followed by a faster fall in the viral load. The cumulative viral load over the 10 week period was then determined and this showed similarly that only group 2 macaques had a significantly lower viral load compared with the unimmunized group 4 animals (FIG. 4B). Two of the 8 macaques in this group remained uninfected and if these are removed the peak (p=0.017) and cumulative (p=0.049) viral load still show a significant decrease in the 6 animals. These results suggest that all vaccine components are required to prevent or inhibit viral infection, as demonstrated in group 2 macaques. The other 3 immunized groups of animals either lacked HIVgp140 and SIVgag p27 (group 1) or HLA-I and II antigens (group 3) or the Titermax adjuvant (group 5).

Measurement of HLA-I and HLA-II Antibodies in Serum from Immunized Animals

The Luminex HLA antibody method was used to assay specific antibodies to the 5 immunizing HLA-class I and 1 HLA-class II antigens. The sera were initially screened for the presence, or absence, of antibodies specific to HLA Class I or Class II molecules using the Luminex bead based technology (kits from OneLambda Inc.). Briefly, these kits consist of 12 separate bead groups coated with a number of HLA Class I molecules and 5 separate bead groups coated with a number of HLA Class II molecules. They contain all the common, and many of the rare, HLA specificities. The HLA molecules for these beads are isolated from the surface of donor cells and attached by covalent bonds to the luminex beads. Two internal control bead groups, one negative (NC) and one positive (PC) provide background binding information and ensure the test is performing correctly. The beads are incubated with the test sera for 30 minutes, washed, to remove any unbound antibodies and proteins, and then incubated for a further 30 minutes with an appropriate PE conjugated anti-human (IgG) antibody. The beads are then passed through the Luminex analyser, where the level of luminescence from any bound PE is detected and recorded as the Median Fluorescence Index or MFI. The results are analysed by the kit-specific HLA Visual software (OneLambda). The calculation used for screening is:

Test bead Ratio=MFI of Test bead with test sample–
MFI of Test bead with Neq control/Internal test
sample NC bead–Internal Neg control NC bead The calculated ratio then serves as the result for each bead, the current cut-off values are ratio >1.3 for class I and >2.5 for class II. The screening results are recorded as either 'positive' or 'negative', with a score representing the number of beads groups showing positivity.

The sera were initially screened neat, and any positive samples were then screened at 1:100 dilutions (in human AB serum) and again, any positive samples were further tested at 1:1000 dilution. The sera were then tested for the specificity of any HLA antibodies present using Luminex bead based single antigen screening, again, with kits from OneLambda Inc. These kits use the same luminex beads but with 99 bead groups used in the Class I specific kit and 85 in the Class II specific kit. Here each bead group is coated with molecules of a single HLA specificity. The HLA molecules for these kits are recombinant in nature, which may effect their final conformation. The sera were tested at 1:1000 dilution, in human AB serum, to reduce non-specific background binding to the beads. The analysis was again performed using the HLA Visual software and the results are presented as MFI in which the internal negative control MFI is subtracted. MFI>1000 was recorded as specific HLA antibody to the antigen coated bead.

High antibody levels were elicited to all the immunizing HLA-I and II recombinant antigens at a serum dilution of 1:100 in groups 1, 2 and 5 and these were absent in the pre-immunization sera. These antibodies were not detected in group 3 (without HLA antigens) or in the unimmunized group 4 animals. However, at a serum dilution of 1:1000 only groups 1 and 2 showed significant antibody levels expressed as MFI (FIG. 5).

As the recombinant HLA antigens were not previously used for immunization, the sera from groups 1 and 2 were analysed by the Luminex HLA multibead antibody (LHMA) for HLA class I and II. Significant correlation was found between antibodies to HLA-DR4 immunizing antigen and the LHMA assay with sera from both group 1 (p=0.009) and group 2 (p=0.028) immunized macaques (FIG. 6A, B). Whereas antibodies to all 5 HLA-I and the HLA-2 immunizing antigens showed significant correlation with the LHAM assay in group 2 (FIG. 6B, D; range p=0.017-p=0.0002), this was not found in the sera from group 1 animals (FIG. 6A, C, representative illustrations of HLA-I A02). These results are consistent with the recombinant HLA-I and II construct expressing conformational structures recognized by the LHMA assay in group 2 sera (FIG. 6C). The significance of HLA-class I antibodies was strengthened by the significant inverse correlation of group 2 macaques with the peak viral load of all 5 HLA-1 alleles (p=from 0.01 to 0.0001) and with the cumulative viral load of HLA-A1, A2 and A24 (p=from 0.045 to 0.0004). However, HLA-DR4 antibodies failed to show any correlation with the viral load. HLA-I antibodies were also significantly correlated with the neutralizing activity (see below) in group 2 (p=0.032), and so did HLA-II antibodies (p=0.025).

Measurement of Neutralizing Activity of Sera from Immunized Macaques

Macaque sera obtained at time points before, during, and after the immunization regime were tested for their relative in vitro neutralizing activity against the challenge virus SHIV.SF162 P4. Macaque sera were tested for their neutralization activity against SHIV.SF162 P4 propagated on C8166.CCR5 cells, using a TZM-bl based assay.

Neutralization activity in serum was analyzed both in the presence of complement, using serum from a healthy AB+ blood donor as a source of complement, and in the absence of complement, using heat-inactivated AB+ serum. To inhibit replication of the virus in TZM-bl cells, a final concentration of 1 µM indinavir (AIDS reagent program #8145) was added to Iscove's modified Dulbecco medium supplemented with 10% AB+serum, penicillin (100 U/ml), streptomycin (100 µg/ml), and DEAE dextran (37.5 µg/ml).

TZM-bl cells were seeded one day in advance at 4.000 cells per well. A final inoculum of 20 $TCID_{50}$ SHIV.SF162 P4 in a volume of 50 µl was incubated for 1 h at 37° C. with twofold serial dilutions of macaque serum (range 1:40-1:1280), and was then added to the TZM-bl cells. Peptide competition assays were performed as described above, except that serum dilutions were pre-incubated with BaL V3 peptide (TRPNNNTRKSIHIGPGRAFYTTG) or scrambled peptide (NKGTHNIPTARNIYGFPTSRRGT) at a final concentration of 20 µg/ml for 30 min at 37° C. before the addition of virus. After 4 h incubation at 37° C., TZM-bl cells were washed once with 150 µl phosphate-buffered saline (PBS), and subsequently replenished in 200 µl IMDM supplemented with 10% fetal bovine serum, penicillin (100 U/ml), streptomycin (100 µg/ml), and DEAE dextran (37.5 µg/ml). After 48 hours, the cells were again washed in 150 µl PBS. Next, 25 µl freshly prepared luciferase substrate (0.83 mM ATP, 0.83 mM d-luciferin [Duchefa Biochemie B.V., Haarlem, The Netherlands], 18.7 mM $MgCl_2$, 0.78 µM $Na_2H_2P_2O_7$, 38.9 mM Tris [pH 7.8], 0.39% [vol/vol] glycerol, 0.03% [vol/vol] Triton X-100, and 2.6 µM dithiothreitol) was added and luminescence was measured for 1 s per well. Experiments were performed in triplicate. For calculations, the background luciferase expression was subtracted from the relative light units (RLU) of the test wells. The percent neutralization was calculated by determining the reduction in luciferase expression in the presence of neutralizing agent compared to the cultures with virus only. When possible, 50% inhibitory concentrations ($IC_{50}$) were determined by linear regression. For calculations, viruses with $IC_{50}$s of <40 or >1280 were assigned a value of 20 or 1280, respectively.

Sera from group 1 and group 2 macaques, both immunized with HLA-1 and II containing vaccine, neutralizing activity was observed only in the presence of complement, indicating that the anti-viral activity in these sera may have been mediated by anti-HLA antibodies (FIG. 7A). In contrast, sera from group 3 animals, immunized with HIVgp140 and SIVp27 but not with HLA antigens yielded significant neutralizing activity without (FIG. 7B) or with (FIG. 7A) complement. Neutralizing activity in serum became detectable after the second immunization, and was enhanced in some but not all animals after the third and/or fourth immunization. No inhibition of a VSV-G pseudotyped HIV variant was observed by group 1 and group 2 sera in the presence of complement (data not shown), indicating that the observed neutralizing activity in group 1 and group 2 sera was not the result of an effect of these sera on the viability of the target cells in the neutralization assay. Furthermore, neutralizing activity of sera from 5/8 group 3 animals was inhibited in the presence of BaL V3 peptides, suggesting that the activity in these sera may be directed against the viral envelope. In contrast, the neutralizing activity in sera from group 2 animals was not reduced in the presence of BaL V3 peptides. Together with the lack of neutralizing activity in group 2 sera in the absence of complement, these results indicate that the immunization regime in group 2 animals has not elicited anti-Env neutralizing antibodies at levels that can be detected in this assay. However, the neutralization titers of sera from group 3 animals were lower compared to titers of sera from group 1 and 2 animals. Neutralization activity of sera from group 5 animals obtained after the last immunization was only slightly enhanced in the presence of complement compared to sera from the control animals (FIG. 7A), suggesting that the Titermax adjuvant was essential for the development of a potent neutralizing activity.

The next point addressed was whether the differential peak and cumulative viral load after challenge in the 5 groups of macaques, may have been the result of inhibition of the challenge virus SHIV SF162.P4 by the neutralizing activity elicited in response to immunization. To this end, we examined any correlation between the complement dependent neutralizing activity $IC_{50}$ of sera obtained at the time of viral challenge against SHIV.SF162 P4 and the viral load at several time points after viral challenge. The neutralizing activity showed significant inverse correlation with the peak viral load only in group 2 animals (P=0.043, FIG. 7C) suggesting that the presence of anti-viral activity in serum may have influenced the early stages of viral replication. The cumulative viral load, however failed to be significantly correlated with the neutralizing activity (FIG. 7D). It is noteworthy that the neutralizing activity was also significantly correlated with HLA-class I antibodies only in group 2 sera (n=0.032), unlike those of HLA-class 2, which showed significant correlation with sera in group 1 (p=0.025) and 2 (p=0.006).

These data demonstrates that a pharmamer vaccine composition comprising 5 different biologically active molecules (HLA I-peptide complexes, HLA II molecule, SIVp27, truncated HSP70 and gp140trimer) attached to one or more of 4 Dextran270 multimerization domains can induce an immune response against SHIV. Systemic immunization (SC×4) with a vaccine composition comprising 4 pharmamers comprising 1-3 of the 5 biologically active molecules denoted above and comprising the adjuvant Titermax Gold in group 2 macaques elicited a significant decrease in both the peak viral load 2-3 weeks after IV challenge with SHIV SF162.P4 and the cumulative viral load over the whole period of 10 weeks (p<0.05). Two of the 8 animals remained uninfected. HLA-class I and II proteins were essential in protecting the macaques as Group 3 animals immunized without them showed no protection.

This indicates that such af pharmamer vaccine composition could be used for prophylactic treatment against HIV infection in uninfected individuals.

Example 8

This is an example of generation of a pharmamers that can be used in a vaccine composition for treatment of SIV/HIV.

4 different vaccine compositions are generated comprising between 1-4 pharmamers whereto 3-5 different biological active molecules are attached. The multimerization domain in all pharmamers is Streptavidin (SA) coupled Dextran (270 kDa) and the biologically active molecules are attached to the SA-Dextran backbone by a non-covalent interaction between SA and biotin on the biologically active molecules. In the following generation of the individual components in the pharmamers are described:

Generation of Multimerization Domain:

Dextran270 are coupled with SA using the following procedure. Divinyl sulfone acid activated Dextran270 are mixed with SA in a molar ratio of 1:13 (Dextran270:SA) in buffer (0.025 M $NaHCO_3$, 0.1 M NaCl) for 2 hours at 40° C. The final concentration of Dextran270 was 6 uM. Then the reaction was stopped by adding 10 vol % 0.165 M Cystein, incubation for 30 minutes at 40° C. Excess SA was removed by gelfiltration on a Superdex 200-column and the buffer exchanged to 0,1M NaCl; 10 mM CHES; pH 9.0.

The final product has between 8 and 9 SA molecules per Dextran molecule in average.

Generation of Biotinylated Biologically Active Molecules:

Four different biotinylated MHC I-peptide complexes are generated:

HLA-A*0101(IVDCLTEMY) SEQ ID NO 9588), HLA-A*1101 (IVTDFSVIK) SEQ ID NO 9589), HLA-A*0201 (GLIQLVEGV) SEQ ID NO 9590, HLA-A*0301(RIAAW-MATY) SEQ ID NO 9591.

The protein coding sequences minus the signal peptide and transmembrane regions of all of the 4 human MHC class 1 heavy chain molecules are obtained from GenBank and the sequence backtranslated according to *E. coli* codon usage using www.entelechon.com. The gene is synthesized e.g. by PCR using 10 overlapping DNA primers (DNA Technology, Denmark) and KOD polymerase (EMD Chemicals, Novagen). Sequence is verified by repeated DNA sequencing (MWG Biotech, Ebersberg, Germany) and base errors introduced is corrected using Quick Change multi site-directed mutagenesis kit (Stratagene, La Jolla, Calif.) before cloning in pGarboczi (Garboczi et al 1992). A DNA-sequence encoding a C-terminal Cystein residue is introduced by site directed mutagenesis. Human beta2Microblulin (β2m) (GenBank acc # CAG33347.1) is acquired and cloned. Recombinant MHC 1 heavy chain and β2m protein is produced by fermentation, isolated and purified by column chromatography.

MHC-peptide complexes aregenerated by in vitro refolding of heavy chain, β2m and peptide in a buffer containing reduced and oxidized glutathione as described for generation of MHC I-peptide complexes in example 6. Following refolding the MHC complexes are chemically biotinylated on the C-terminal cystein residue by treating them with Maleimide-biotin (EZ-link Maleimide-PEO2-Biotin). The reaction can be carried out in PBS, PH 7.0 for 2½ hour at 4° C., with a Maleimide-biotin: MHC-peptide molar ratio equal to 1.5 (1.6 ug Maleimide-biotin per 100 ug B*0801-cys-peptide complex). Excess Maleimide-biotin are removed and the buffer optionally exchanged to e.g. 20 mM Tris-HCl, 50 mM NaCl, pH 8.0 by gel filtration in a G-25 column. Efficiency of biotinylation may be determined using a SDS PAGE shift assay with SA. 1 ug Maleimide-biotin treated MHC-peptide complex is incubated with 1.8 ug SA in 12 ul PBS, pH 7.0 for 1 hour at room temperature. Then the sample is analyzed by SDS PAGE together with samples of various concentrations of Maleimide-biotin treated B*0801-cys-peptide complex not incubated with SA and a sample with SA alone. The degree of biotinylation is estimated by comparing amount of monomer MHC-peptide complex when incubated with SA and without SA.

Generation of Biotinylated SIVp27, Trimer Qp140, DR4 and Truncated HSP70 Molecules.

Trimeric HIVgp140, DR4, C-terminal fragment of HSP70 and SIVp27 molecules are generated as described in example 6 but with the following modification. A C-terminal cystein are introduced in all molecules e.g. by introducing DNA bases encoding Cystein in the C-terminal of the molecules e.g. by site directed mutagenesis or by PCR with primers encoding a C-terminal cystein. Following expression, folding and purification of these molecules as described in example 6 the molecules are chemically biotinylated e.g. using the procedure described above for MJHC I-peptide complexes.

Linking the Biologically Active Molecules to Multimerization Domain

The following pharmamer constructs are made:
1) Dextran270+HLA-A*0101(IVDCLTEMY) (SEQ ID NO 9588)+DR4+HSP70 (molar ratio 1:10:10:4)
2) Dextran270+HLA-A*0201(GLIQLVEGV) (SEQ ID NO 9590)+HLA-A*0301(RIAAWMATY) (SEQ ID NO 9591)+HSP70 (molar ratio 1:10:10:4)
3) Dextran270+HLA-A*1101 (IVTDFSVIK) SEQ ID NO 9589)+HSP70 (molar ratio 1:10:4)
4) Dextran270+HIVgp140+Sivp27+HSP70 (molar ratio 1:3:10:4)

The 4 constructs are made by mixing Dextran270 with the above said biotinylated biological molecules (HLA I-peptide complexes, DR4 molecules, trimeric HIVgp140, SIVp27 and/or HSP70 (359-609)) in molar ratios as described. The final concentration of Dextran is 0.005-0.1 M.

These pharmamers may be used in a composition for vaccination of individuals with HIV or vaccination of healthy individuals for preventing infection with HIV, e.g. as described in example 7.

Example 9

This is an example of generation of a pharmamers that can be used in a vaccine composition for treatment of a viral infection.

Different vaccine compositions are generated comprising between one or more pharmamers whereto 1-8 different biological active molecules are attached. One or more of the biologically active molecules may derive from the virus in question. One or more other biologically active molecules may be immunologically active molecules. The multimerization domain in all pharmamers is Streptavidin (SA) coupled Dextran (270 kDa) and the biologically active molecules are attached to the SA-Dextran backbone by a non-covalent interaction between SA and biotin on the biologically active molecules.

Generation of Biologically Active Molecules

The biologically active molecules are generated by cloning, expression and purification in suitable expression systems known by persons skilled in the art. A C-terminal cystein residue is introduced in all molecules by fusing the dNA sequence encoding the biological molecules in question to a DNA sequence encoding a cystein residue. Following purification of the biologically active molecules they are chemically biotinylated e.g. using the procedure described in example 6.

Generation of Multimerization Domain:

Dextran270 or another larger or smaller Dextran molecule are activated with Divinyl sulfone acid and coupled with SA using a procedure like the one described in example 6. The amount of SA molecules coupled to the Dextran may be adjusted by altering the molar ratio between activated Dextran and SA during coupling.

Linking the Biologically Active Molecules to Multimerization Domain

Biotinylated biologically activated molecules are attached to the SA-Dextran by incubation at room temperature for 10 minutes or longer. The amount of each molecule attached to the SA-Dextran may be adjusted by adjusting the molar ratio between SA-Dextran and the biologically active molecule and/or the ratio between the individual biologically active molecules.

or HSP70 (359-609)) in molar ratios as described. The final concentration of Dextran is 0.005-0.1 M.

Such pharmamers may be used in a composition for vaccination of individuals with a viral infection or vaccination of healthy individuals for preventing infection with the virus in question, e.g. following a procedure as described in example 7 or elsewhere herein.

Example 10

This is an example of how pharmamers with MHC-peptide complexes attached can be used as a *borrelia* vaccine for monkeys.

The vaccine is composed of a Dextran (270 kDa) multimerization domain that has been derivatized by attaching Strepavidin (on average 8.6 Strepavidin molecules/Dextran molecule).

Attached to the carrier are human HLA class 1 and 2 molecules containing antigenic peptides derived from the *Borrelia* antigen Basic membrane protein A (BmpA). The attached HLA-peptide complexes are:

HLA-A*0201(YLAPDNVIT) (SEQ ID NO:9593), HLA-A*0101(YSDEIDIIH) (SEQ ID NO:9594), HLA-B*0702 (APDNVITST) (SEQ ID NO:9595), HLA-DRB1*0401 (IELVLKESSSNSYLS) (SEQ ID NO:9596), HLA-BRB1*1501(MNKILLLILLESIVF) (SEQ ID NO:9597) and HLA-DRB1*1101 (SDLIWLIGYRFSDVA) (SEQ ID NO:9598).

A single full dose of the final vaccine corresponds to, 100 μg of each MHC class 1; 113,5 ug of HLA class 2; 3×25.8 μg HSP70 and 3×162.2 μg dextran (corresponding to a total of approx 300 μg MHC multimer/kg body weight for a monkey of 3.5 kg) and consist of a 1:1:1 mixture of the following three MHC multimers:

MHC Multimer 1:

HLA-A*0101 (YSDEIDIIH) (SEQ ID NO:9594)+HLA-DR*0401 (IELVLKESSSNSYLS) (SEQ ID NO:9596)+HSP70+Dextran carrier, in the molar ratio 10/10/4/1

MHC Multimer 2:

HLA-A*0201 (YLAPDNVIT) (SEQ ID NO:9593)+HLA-DR*1501 (MNKILLLILLESIVF) (SEQ ID NO:9597)+HSP70+Dextran carrier, in the molar ratio 10/10/4/1

MHC Multimer 2:
HLA-B*0702(APDNVITST) (SEQ ID NO:9595)+HLA-DRB1*1101(SDLIWLIGYRFSDVA) (SEQ ID NO:9598)+HSP70+Dextran carrier, in the molar ratio 10/10/4/1

Administration:

The MHC multimer mix is emulsified with the adjuvant Titermax Gold as specified by the
manufacturer and administered as intramuscular injections at time points 0, 4, 8, and 16 weeks such that a full dose is given at 0 weeks and half-full dose at 4, 8, and 16 5 weeks. This vaccine may give protection against infection with *Borrelia* bacteria.

The biological effect of the vaccination may be determined using immune monitoring assays.

A pharmamer composition as described above may also be used for vaccination of human against *Borrelia* infection. In humans the adjuvant Titermax Gold should be replaced with an adjuvant for human use.

Example 11

This is an example of how pharmamers with MHC-peptide complexes attached can be used as a *borrelia* vaccine for monkeys.

The vaccine is composed of an antigen presenting cell (APC) e.g. a Dendritic cell expressing the HLA class 1 molecules HLA-A*0101 and HLA-B*0702. The APC is loaded with antigenic peptides derived from the *Borrelia* protein Basic membrane protein A (BmpA) by incubation with the peptides for 2-5 hours at 37° C. The amino acid sequence of the peptides are YSDEIDIIH (SEQ ID NO:9594) and APDNVITST (SEQ ID NO:9595).

Administration:

The peptide loaded APC are added the adjuvant Titermax Gold as specified by the manufacturer and administered as intramuscular injections at time points 0, 4, 8, and 16 weeks. This vaccine may give protection against infection with *Borrelia* bacteria. The biological effect of the vaccination may be determined using immune monitoring assays as described elsewhere herein A pharmamer composition as described above may also be used for vaccination of human against *Borrelia* infection. In humans the adjuvant Titermax Gold should be replaced with an adjuvant for human use.

SEQUENCE LISTING (9598 sequences)

SEQ ID NO: 1 - protein, 8 aa, HIV-1
MGARASVL

SEQ ID NO: 2 - protein, 8 aa, HIV-1
SVLSGGEL

SEQ ID NO: 3 - protein, 8 aa, HIV-1
ELDRWEKI

SEQ ID NO: 4 - protein, 8 aa, HIV-1
RWEKIRLR

SEQ ID NO: 5 - protein, 8 aa, HIV-1
RLRPGGKK

SEQ ID NO: 6 - protein, 8 aa, HIV-1
KLKHIVWA

SEQ ID NO: 7 - protein, 8 aa, HIV-1
IVWASREL

SEQ ID NO: 8 - protein, 8 aa, HIV-1
WASRELER

SEQ ID NO: 9 - protein, 8 aa, HIV-1
RELERFAV

SEQ ID NO: 10 - protein, 8 aa, HIV-1
FAVNPGLL

SEQ ID NO: 11 - protein, 8 aa, HIV-1
SEGCRQIL

SEQ ID NO: 12 - protein, 8 aa, HIV-1
QLQPSLQT

SEQ ID NO: 13 - protein, 8 aa, HIV-1
LQTGSEEL

SEQ ID NO: 14 - protein, 8 aa, HIV-1
QTGSEELR

SEQ ID NO: 15 - protein, 8 aa, HIV-1
SLYNTVAT

SEQ ID NO: 16 - protein, 8 aa, HIV-1
LYNTVATL

SEQ ID NO: 17 - protein, 8 aa, HIV-1
YNTVATLY

SEQ ID NO: 18 - protein, 8 aa, HIV-1
TVATLYCV

SEQ ID NO: 19 - protein, 8 aa, HIV-1
TLYCVHQR

SEQ ID NO: 20 - protein, 8 aa, HIV-1
LYCVHQRI

SEQ ID NO: 21 - protein, 8 aa, HIV-1
DTKEALDK

SEQ ID NO: 22 - protein, 8 aa, HIV-1
KIEEEQNK

SEQ ID NO: 23 - protein, 8 aa, HIV-1
DTGHSNQV

SEQ ID NO: 24 - protein, 8 aa, HIV-1
QVSQNYPI

SEQ ID NO: 25 - protein, 8 aa, HIV-1
NYPIVQNI

SEQ ID NO: 26 - protein, 8 aa, HIV-1
YPIVQNIQ

SEQ ID NO: 27 - protein, 8 aa, HIV-1
GQMVHQAI

SEQ ID NO: 28 - protein, 8 aa, HIV-1
SPRTLNAW

SEQ ID NO: 29 - protein, 8 aa, HIV-1
RTLNAWVK

SEQ ID NO: 30 - protein, 8 aa, HIV-1
TLNAWVKV

SEQ ID NO: 31 - protein, 8 aa, HIV-1
WVKVVEEK

SEQ ID NO: 32 - protein, 8 aa, HIV-1
KVVEEKAF

SEQ ID NO: 33 - protein, 8 aa, HIV-1
EKAFSPEV

SEQ ID NO: 34 - protein, 8 aa, HIV-1
FSPEVIPM

SEQ ID NO: 35 - protein, 8 aa, HIV-1
SPEVIPMF

SEQ ID NO: 36 - protein, 8 aa, HIV-1
EVIPMFSA

SEQ ID NO: 37 - protein, 8 aa, HIV-1
VIPMFSAL

SEQ ID NO: 38 - protein, 8 aa, HIV-1
IPMFSALS

SEQ ID NO: 39 - protein, 8 aa, HIV-1
FSALSEGA

SEQ ID NO: 40 - protein, 8 aa, HIV-1
ALSEGATP

SEQ ID NO: 41 - protein, 8 aa, HIV-1
TPQDLNTM

SEQ ID NO: 42 - protein, 8 aa, HIV-1
NTVGGHQA

SEQ ID NO: 43 - protein, 8 aa, HIV-1
TVGGHQAA

SEQ ID NO: 44 - protein, 8 aa, HIV-1
HQAAMQML

SEQ ID NO: 45 - protein, 8 aa, HIV-1
QAAMQMLK

SEQ ID NO: 46 - protein, 8 aa, HIV-1
MQMLKETI

SEQ ID NO: 47 - protein, 8 aa, HIV-1
ETINEEAA

SEQ ID NO: 48 - protein, 8 aa, HIV-1
EEAAEWDR

SEQ ID NO: 49 - protein, 8 aa, HIV-1
EAAEWDRV

SEQ ID NO: 50 - protein, 8 aa, HIV-1
EWDRVHPV

SEQ ID NO: 51 - protein, 8 aa, HIV-1
HPVHAGPI

SEQ ID NO: 52 - protein, 8 aa, HIV-1
GPIAPGQM

SEQ ID NO: 53 - protein, 8 aa, HIV-1
WMTNNPPI

SEQ ID NO: 54 - protein, 8 aa, HIV-1
TNNPPIPV

SEQ ID NO: 55 - protein, 8 aa, HIV-1
PPIPVGEI

SEQ ID NO: 56 - protein, 8 aa, HIV-1
PIPVGEIY

SEQ ID NO: 57 - protein, 8 aa, HIV-1
GEIYKRWI

SEQ ID NO: 58 - protein, 8 aa, HIV-1
EIYKRWII

SEQ ID NO: 59 - protein, 8 aa, HIV-1
IYKRWIIL

SEQ ID NO: 60 - protein, 8 aa, HIV-1
KRWIILGL

SEQ ID NO: 61 - protein, 8 aa, HIV-1
WIILGLNK

SEQ ID NO: 62 - protein, 8 aa, HIV-1
IILGLNKI

SEQ ID NO: 63 - protein, 8 aa, HIV-1
ILGLNKIV

SEQ ID NO: 64 - protein, 8 aa, HIV-1
LGLNKIVR

SEQ ID NO: 65 - protein, 8 aa, HIV-1
GLNKIVRM

SEQ ID NO: 66 - protein, 8 aa, HIV-1
IVRMYSPT

SEQ ID NO: 67 - protein, 8 aa, HIV-1
RMYSPTSI

SEQ ID NO: 68 - protein, 8 aa, HIV-1
MYSPTSIL

SEQ ID NO: 69 - protein, 8 aa, HIV-1
SPTSILDI

SEQ ID NO: 70 - protein, 8 aa, HIV-1
RQGPKEPF

SEQ ID NO: 71 - protein, 8 aa, HIV-1
DYVDRFYK

SEQ ID NO: 72 - protein, 8 aa, HIV-1
YVDRFYKT

SEQ ID NO: 73 - protein, 8 aa, HIV-1
DRFYKTLR

SEQ ID NO: 74 - protein, 8 aa, HIV-1
AEQASQEV

SEQ ID NO: 75 - protein, 8 aa, HIV-1
EQASQEVK

SEQ ID NO: 76 - protein, 8 aa, HIV-1
ASQEVKNW

SEQ ID NO: 77 - protein, 8 aa, HIV-1
EVKNWMTE

SEQ ID NO: 78 - protein, 8 aa, HIV-1
NWMTETLL

SEQ ID NO: 79 - protein, 8 aa, HIV-1
WMTETLLV

SEQ ID NO: 80 - protein, 8 aa, HIV-1
ETLLVQNA

SEQ ID NO: 81 - protein, 8 aa, HIV-1
NPDCKTIL

SEQ ID NO: 82 - protein, 8 aa, HIV-1
ILKALGPA

SEQ ID NO: 83 - protein, 8 aa, HIV-1
ALGPAATL

SEQ ID NO: 84 - protein, 8 aa, HIV-1
TLEEMMTA

SEQ ID NO: 85 - protein, 8 aa, HIV-1
EEMMTACQ

SEQ ID NO: 86 - protein, 8 aa, HIV-1
MMTACQGV

SEQ ID NO: 87 - protein, 8 aa, HIV-1
GVGGPGHK

SEQ ID NO: 88 - protein, 8 aa, HIV-1
VLAEAMSQ

SEQ ID NO: 89 - protein, 8 aa, HIV-1
AEAMSQVT

SEQ ID NO: 90 - protein, 8 aa, HIV-1
SQVTNSAT

SEQ ID NO: 91 - protein, 8 aa, HIV-1
VTNSATIM

SEQ ID NO: 92 - protein, 8 aa, HIV-1
SATIMMQR

SEQ ID NO: 93 - protein, 8 aa, HIV-1
IMMQRGNF

SEQ ID NO: 94 - protein, 8 aa, HIV-1
MMQRGNFR

SEQ ID NO: 95 - protein, 8 aa, HIV-1
RGNFRNQR

SEQ ID NO: 96 - protein, 8 aa, HIV-1
RNQRKIVK

SEQ ID NO: 97 - protein, 8 aa, HIV-1
HTARNCRA

SEQ ID NO: 98 - protein, 8 aa, HIV-1
RNCRAPRK

SEQ ID NO: 99 - protein, 8 aa, HIV-1
NCRAPRKK

SEQ ID NO: 100 - protein, 8 aa, HIV-1
APRKKGCW

SEQ ID NO: 101 - protein, 8 aa, HIV-1
QMKDCTER

SEQ ID NO: 102 - protein, 8 aa, HIV-1
CTERQANF

SEQ ID NO: 103 - protein, 8 aa, HIV-1
TERQANFL

SEQ ID NO: 104 - protein, 8 aa, HIV-1
ERQANFLR

SEQ ID NO: 105 - protein, 8 aa, HIV-1
RQANFLRE

SEQ ID NO: 106 - protein, 8 aa, HIV-1
FLREDLAF

SEQ ID NO: 107 - protein, 8 aa, HIV-1
DLAFLQGK

SEQ ID NO: 108 - protein, 8 aa, HIV-1
AFLQGKAR

SEQ ID NO: 109 - protein, 8 aa, HIV-1
FLQGKARE

SEQ ID NO: 110 - protein, 8 aa, HIV-1
LQGKAREF

SEQ ID NO: 111 - protein, 8 aa, HIV-1
REFSSEQT

SEQ ID NO: 112 - protein, 8 aa, HIV-1
EFSSEQTR

SEQ ID NO: 113 - protein, 8 aa, HIV-1
FSSEQTRA

SEQ ID NO: 114 - protein, 8 aa, HIV-1
QTRANSPT

SEQ ID NO: 115 - protein, 8 aa, HIV-1
RANSPTRR

SEQ ID NO: 116 - protein, 8 aa, HIV-1
GADRQGTV

SEQ ID NO: 117 - protein, 8 aa, HIV-1
TVSFNFPQ

SEQ ID NO: 118 - protein, 8 aa, HIV-1
VSFNFPQV

SEQ ID NO: 119 - protein, 8 aa, HIV-1
FNFPQVTL

SEQ ID NO: 120 - protein, 8 aa, HIV-1
NFPQVTLW

SEQ ID NO: 121 - protein, 8 aa, HIV-1
TLWQRPLV

SEQ ID NO: 122 - protein, 8 aa, HIV-1
WQRPLVTI

SEQ ID NO: 123 - protein, 8 aa, HIV-1
RPLVTIKI

SEQ ID NO: 124 - protein, 8 aa, HIV-1
GQLKEALL

SEQ ID NO: 125 - protein, 8 aa, HIV-1
TGADDTVL

SEQ ID NO: 126 - protein, 8 aa, HIV-1
TVLEEMSL

SEQ ID NO: 127 - protein, 8 aa, HIV-1
EEMSLPGR

SEQ ID NO: 128 - protein, 8 aa, HIV-1
MSLPGRWK

SEQ ID NO: 129 - protein, 8 aa, HIV-1
SLPGRWKP

SEQ ID NO: 130 - protein, 8 aa, HIV-1
KPKMIGGI

SEQ ID NO: 131 - protein, 8 aa, HIV-1
GIGGFIKV

SEQ ID NO: 132 - protein, 8 aa, HIV-1
RQYDQILI

SEQ ID NO: 133 - protein, 8 aa, HIV-1
EICGHKAI

SEQ ID NO: 134 - protein, 8 aa, HIV-1
HKAIGTVL

SEQ ID NO: 135 - protein, 8 aa, HIV-1
KAIGTVLV

SEQ ID NO: 136 - protein, 8 aa, HIV-1
VLVGPTPV

SEQ ID NO: 137 - protein, 8 aa, HIV-1
GPTPVNII

SEQ ID NO: 138 - protein, 8 aa, HIV-1
TPVNIIGR

SEQ ID NO: 139 - protein, 8 aa, HIV-1
NIIGRNLL

SEQ ID NO: 140 - protein, 8 aa, HIV-1
NLLTQIGC

SEQ ID NO: 141 - protein, 8 aa, HIV-1
LNFPISPI

SEQ ID NO: 142 - protein, 8 aa, HIV-1
FPISPIET

SEQ ID NO: 143 - protein, 8 aa, HIV-1
PISPIETV

SEQ ID NO: 144 - protein, 8 aa, HIV-1
SPIETVPV

SEQ ID NO: 145 - protein, 8 aa, HIV-1
IETVPVKL

SEQ ID NO: 146 - protein, 8 aa, HIV-1
ETVPVKLK

SEQ ID NO: 147 - protein, 8 aa, HIV-1
VPVKLKPG

SEQ ID NO: 148 - protein, 8 aa, HIV-1
KVKQWPLT

SEQ ID NO: 149 - protein, 8 aa, HIV-1
KQWPLTEE

SEQ ID NO: 150 - protein, 8 aa, HIV-1
WPLTEEKI

SEQ ID NO: 151 - protein, 8 aa, HIV-1
TEEKIKAL

SEQ ID NO: 152 - protein, 8 aa, HIV-1
EEKIKALV

SEQ ID NO: 153 - protein, 8 aa, HIV-1
KIKALVEI

SEQ ID NO: 154 - protein, 8 aa, HIV-1
LVEICTEM

SEQ ID NO: 155 - protein, 8 aa, HIV-1
EICTEMEK

SEQ ID NO: 156 - protein, 8 aa, HIV-1
KIGPENPY

SEQ ID NO: 157 - protein, 8 aa, HIV-1
ENPYNTPV

SEQ ID NO: 158 - protein, 8 aa, HIV-1
NPYNTPVF

SEQ ID NO: 159 - protein, 8 aa, HIV-1
YNTPVFAI

SEQ ID NO: 160 - protein, 8 aa, HIV-1
NTPVFAIK

SEQ ID NO: 161 - protein, 8 aa, HIV-1
TPVFAIKK

SEQ ID NO: 162 - protein, 8 aa, HIV-1
PVFAIKKK

SEQ ID NO: 163 - protein, 8 aa, HIV-1
STKWRKLV

SEQ ID NO: 164 - protein, 8 aa, HIV-1
KWRKLVDF

SEQ ID NO: 165 - protein, 8 aa, HIV-1
KLVDFREL

SEQ ID NO: 166 - protein, 8 aa, HIV-1
DFRELNKR

SEQ ID NO: 167 - protein, 8 aa, HIV-1
RTQDFWEV

SEQ ID NO: 168 - protein, 8 aa, HIV-1
QLGIPHPA

SEQ ID NO: 169 - protein, 8 aa, HIV-1
GIPHPAGL

SEQ ID NO: 170 - protein, 8 aa, HIV-1
IPHPAGLK

SEQ ID NO: 171 - protein, 8 aa, HIV-1
GLKKKKSV

SEQ ID NO: 172 - protein, 8 aa, HIV-1
VLDVGDAY

SEQ ID NO: 173 - protein, 8 aa, HIV-1
VGDAYFSV

SEQ ID NO: 174 - protein, 8 aa, HIV-1
DAYFSVPL

SEQ ID NO: 175 - protein, 8 aa, HIV-1
SVPLDEDF

SEQ ID NO: 176 - protein, 8 aa, HIV-1
PLDEDFRK

SEQ ID NO: 177 - protein, 8 aa, HIV-1
DFRKYTAF

SEQ ID NO: 178 - protein, 8 aa, HIV-1
RKYTAFTI

SEQ ID NO: 179 - protein, 8 aa, HIV-1
YTAFTIPS

SEQ ID NO: 180 - protein, 8 aa, HIV-1
TAFTIPSI

SEQ ID NO: 181 - protein, 8 aa, HIV-1
IPSINNET

SEQ ID NO: 182 - protein, 8 aa, HIV-1
NETPGIRY

SEQ ID NO: 183 - protein, 8 aa, HIV-1
ETPGIRYQ

SEQ ID NO: 184 - protein, 8 aa, HIV-1
TPGIRYQY

SEQ ID NO: 185 - protein, 8 aa, HIV-1
GIRYQYNV

SEQ ID NO: 186 - protein, 8 aa, HIV-1
IRYQYNVL

SEQ ID NO: 187 - protein, 8 aa, HIV-1
YQYNVLPQ

SEQ ID NO: 188 - protein, 8 aa, HIV-1
NVLPQGWK

SEQ ID NO: 189 - protein, 8 aa, HIV-1
IFQSSMTK

SEQ ID NO: 190 - protein, 8 aa, HIV-1
FQSSMTKI

SEQ ID NO: 191 - protein, 8 aa, HIV-1
MTKILEPF

SEQ ID NO: 192 - protein, 8 aa, HIV-1
TKILEPFR

SEQ ID NO: 193 - protein, 8 aa, HIV-1
KILEPFRK

SEQ ID NO: 194 - protein, 8 aa, HIV-1
KQNPDIVI

SEQ ID NO: 195 - protein, 8 aa, HIV-1
DIVIYQYM

SEQ ID NO: 196 - protein, 8 aa, HIV-1
IYQYMDDL

SEQ ID NO: 197 - protein, 8 aa, HIV-1
YQYMDDLY

SEQ ID NO: 198 - protein, 8 aa, HIV-1
QYMDDLYV

SEQ ID NO: 199 - protein, 8 aa, HIV-1
YMDDLYVG

SEQ ID NO: 200 - protein, 8 aa, HIV-1
DLYVGSDL

SEQ ID NO: 201 - protein, 8 aa, HIV-1
YVGSDLEI

SEQ ID NO: 202 - protein, 8 aa, HIV-1
DLEIGQHR

SEQ ID NO: 203 - protein, 8 aa, HIV-1
EIGQHRTK

SEQ ID NO: 204 - protein, 8 aa, HIV-1
RTKIEELR

SEQ ID NO: 205 - protein, 8 aa, HIV-1
IEELRQHL

SEQ ID NO: 206 - protein, 8 aa, HIV-1
EELRQHLL

SEQ ID NO: 207 - protein, 8 aa, HIV-1
ELRQHLLR

SEQ ID NO: 208 - protein, 8 aa, HIV-1
HLLRWGLT

SEQ ID NO: 209 - protein, 8 aa, HIV-1
LLRWGLTT

SEQ ID NO: 210 - protein, 8 aa, HIV-1
KEPPFLWM

SEQ ID NO: 211 - protein, 8 aa, HIV-1
PPFLWMGY

SEQ ID NO: 212 - protein, 8 aa, HIV-1
FLWMGYEL

SEQ ID NO: 213 - protein, 8 aa, HIV-1
GYELHPDK

SEQ ID NO: 214 - protein, 8 aa, HIV-1
YELHPDKW

SEQ ID NO: 215 - protein, 8 aa, HIV-1
ELHPDKWT

SEQ ID NO: 216 - protein, 8 aa, HIV-1
LHPDKWTV

SEQ ID NO: 217 - protein, 8 aa, HIV-1
WTVQPIVL

SEQ ID NO: 218 - protein, 8 aa, HIV-1
WTVNDIQK

SEQ ID NO: 219 - protein, 8 aa, HIV-1
TVNDIQKL

SEQ ID NO: 220 - protein, 8 aa, HIV-1
IQKLVGKL

SEQ ID NO: 221 - protein, 8 aa, HIV-1
KLVGKLNW

SEQ ID NO: 222 - protein, 8 aa, HIV-1
KLNWASQI

SEQ ID NO: 223 - protein, 8 aa, HIV-1
SQIYPGIK

SEQ ID NO: 224 - protein, 8 aa, HIV-1
QIYPGIKV

SEQ ID NO: 225 - protein, 8 aa, HIV-1
IYPGIKVR

SEQ ID NO: 226 - protein, 8 aa, HIV-1
KVRQLCKL

SEQ ID NO: 227 - protein, 8 aa, HIV-1
RQLCKLLR

SEQ ID NO: 228 - protein, 8 aa, HIV-1
KLLRGTKA

SEQ ID NO: 229 - protein, 8 aa, HIV-1
LLRGTKAL

SEQ ID NO: 230 - protein, 8 aa, HIV-1
GTKALTEV

SEQ ID NO: 231 - protein, 8 aa, HIV-1
ALTEVIPL

SEQ ID NO: 232 - protein, 8 aa, HIV-1
EVIPLTEE

SEQ ID NO: 233 - protein, 8 aa, HIV-1
PLTEEAEL

SEQ ID NO: 234 - protein, 8 aa, HIV-1
TEEAELEL

SEQ ID NO: 235 - protein, 8 aa, HIV-1
EEAELELA

SEQ ID NO: 236 - protein, 8 aa, HIV-1
ELELAENR

SEQ ID NO: 237 - protein, 8 aa, HIV-1
ELAENREI

SEQ ID NO: 238 - protein, 8 aa, HIV-1
REILKEPV

SEQ ID NO: 239 - protein, 8 aa, HIV-1
KEPVHGVY

SEQ ID NO: 240 - protein, 8 aa, HIV-1
EPVHGVYY

SEQ ID NO: 241 - protein, 8 aa, HIV-1
GVYYDPSK

SEQ ID NO: 242 - protein, 8 aa, HIV-1
YYDPSKDL

SEQ ID NO: 243 - protein, 8 aa, HIV-1
DLIAEIQK

SEQ ID NO: 244 - protein, 8 aa, HIV-1
AEIQKQGQ

SEQ ID NO: 245 - protein, 8 aa, HIV-1
KQGQGQWT

SEQ ID NO: 246 - protein, 8 aa, HIV-1
GQGQWTYQ

SEQ ID NO: 247 - protein, 8 aa, HIV-1
GQWTYQIY

SEQ ID NO: 248 - protein, 8 aa, HIV-1
YQIYQEPF

SEQ ID NO: 249 - protein, 8 aa, HIV-1
QIYQEPFK

SEQ ID NO: 250 - protein, 8 aa, HIV-1
YQEPFKNL

SEQ ID NO: 251 - protein, 8 aa, HIV-1
NLKTGKYA

SEQ ID NO: 252 - protein, 8 aa, HIV-1
KTGKYARM

SEQ ID NO: 253 - protein, 8 aa, HIV-1
TGKYARMR

SEQ ID NO: 254 - protein, 8 aa, HIV-1
RMRGAHTN

SEQ ID NO: 255 - protein, 8 aa, HIV-1
HTNDVKQL

SEQ ID NO: 256 - protein, 8 aa, HIV-1
QLTEAVQK

SEQ ID NO: 257 - protein, 8 aa, HIV-1
KITTESIV

SEQ ID NO: 258 - protein, 8 aa, HIV-1
TTESIVIW

SEQ ID NO: 259 - protein, 8 aa, HIV-1
ESIVIWGK

SEQ ID NO: 260 - protein, 8 aa, HIV-1
VIWGKTPK

SEQ ID NO: 261 - protein, 8 aa, HIV-1
IWGKTPKF

SEQ ID NO: 262 - protein, 8 aa, HIV-1
TPKFKLPI

SEQ ID NO: 263 - protein, 8 aa, HIV-1
KFKLPIQK

SEQ ID NO: 264 - protein, 8 aa, HIV-1
LPIQKETW

SEQ ID NO: 265 - protein, 8 aa, HIV-1
IQKETWET

SEQ ID NO: 266 - protein, 8 aa, HIV-1
KETWETWW

SEQ ID NO: 267 - protein, 8 aa, HIV-1
ETWETWWT

SEQ ID NO: 268 - protein, 8 aa, HIV-1
WETWWTEY

SEQ ID NO: 269 - protein, 8 aa, HIV-1
ETWWTEYW

SEQ ID NO: 270 - protein, 8 aa, HIV-1
TEYWQATW

SEQ ID NO: 271 - protein, 8 aa, HIV-1
EYWQATWI

SEQ ID NO: 272 - protein, 8 aa, HIV-1
WQATWIPE

SEQ ID NO: 273 - protein, 8 aa, HIV-1
QATWIPEW

SEQ ID NO: 274 - protein, 8 aa, HIV-1
TWIPEWEF

SEQ ID NO: 275 - protein, 8 aa, HIV-1
WIPEWEFV

SEQ ID NO: 276 - protein, 8 aa, HIV-1
FVNTPPLV

SEQ ID NO: 277 - protein, 8 aa, HIV-1
NTPPLVKL

SEQ ID NO: 278 - protein, 8 aa, HIV-1
TPPLVKLW

SEQ ID NO: 279 - protein, 8 aa, HIV-1
PPLVKLWY

SEQ ID NO: 280 - protein, 8 aa, HIV-1
PLVKLWYQ

SEQ ID NO: 281 - protein, 8 aa, HIV-1
LVKLWYQL

SEQ ID NO: 282 - protein, 8 aa, HIV-1
KLWYQLEK

SEQ ID NO: 283 - protein, 8 aa, HIV-1
YQLEKEPI

SEQ ID NO: 284 - protein, 8 aa, HIV-1
QLEKEPIV

SEQ ID NO: 285 - protein, 8 aa, HIV-1
EPIVGAET

SEQ ID NO: 286 - protein, 8 aa, HIV-1
IVGAETFY

SEQ ID NO: 287 - protein, 8 aa, HIV-1
VGAETFYV

SEQ ID NO: 288 - protein, 8 aa, HIV-1
ETFYVDGA

SEQ ID NO: 289 - protein, 8 aa, HIV-1
YVDGAANR

SEQ ID NO: 290 - protein, 8 aa, HIV-1
GAANRETK

SEQ ID NO: 291 - protein, 8 aa, HIV-1
KLGKAGYV

SEQ ID NO: 292 - protein, 8 aa, HIV-1
KAGYVTNR

SEQ ID NO: 293 - protein, 8 aa, HIV-1
GYVTNRGR

SEQ ID NO: 294 - protein, 8 aa, HIV-1
VTNRGRQK

SEQ ID NO: 295 - protein, 8 aa, HIV-1
GRQKVVTL

SEQ ID NO: 296 - protein, 8 aa, HIV-1
TLTDTTNQ

SEQ ID NO: 297 - protein, 8 aa, HIV-1
LTDTTNQK

SEQ ID NO: 298 - protein, 8 aa, HIV-1
TTNQKTEL

SEQ ID NO: 299 - protein, 8 aa, HIV-1
KTELQAIY

SEQ ID NO: 300 - protein, 8 aa, HIV-1
TELQAIYL

SEQ ID NO: 301 - protein, 8 aa, HIV-1
ELQAIYLA

SEQ ID NO: 302 - protein, 8 aa, HIV-1
LQAIYLAL

SEQ ID NO: 303 - protein, 8 aa, HIV-1
LQDSGLEV

SEQ ID NO: 304 - protein, 8 aa, HIV-1
SGLEVNIV

SEQ ID NO: 305 - protein, 8 aa, HIV-1
NIVTDSQY

SEQ ID NO: 306 - protein, 8 aa, HIV-1
IVTDSQYA

SEQ ID NO: 307 - protein, 8 aa, HIV-1
VTDSQYAL

SEQ ID NO: 308 - protein, 8 aa, HIV-1
SQYALGII

SEQ ID NO: 309 - protein, 8 aa, HIV-1
YALGIIQA

SEQ ID NO: 310 - protein, 8 aa, HIV-1
ALGIIQAQ

SEQ ID NO: 311 - protein, 8 aa, HIV-1
SELVNQII

SEQ ID NO: 312 - protein, 8 aa, HIV-1
NQIIEQLI

SEQ ID NO: 313 - protein, 8 aa, HIV-1
QIIEQLIK

SEQ ID NO: 314 - protein, 8 aa, HIV-1
IIEQLIKK

SEQ ID NO: 315 - protein, 8 aa, HIV-1
QLIKKEKV

SEQ ID NO: 316 - protein, 8 aa, HIV-1
LIKKEKVY

SEQ ID NO: 317 - protein, 8 aa, HIV-1
KEKVYLAW

SEQ ID NO: 318 - protein, 8 aa, HIV-1
EKVYLAWV

SEQ ID NO: 319 - protein, 8 aa, HIV-1
YLAWVPAH

SEQ ID NO: 320 - protein, 8 aa, HIV-1
LAWVPAHK

SEQ ID NO: 321 - protein, 8 aa, HIV-1
WVPAHKGI

SEQ ID NO: 322 - protein, 8 aa, HIV-1
GIGGNEQV

SEQ ID NO: 323 - protein, 8 aa, HIV-1
QVDKLVSA

SEQ ID NO: 324 - protein, 8 aa, HIV-1
KLVSAGIR

SEQ ID NO: 325 - protein, 8 aa, HIV-1
LVSAGIRK

SEQ ID NO: 326 - protein, 8 aa, HIV-1
GIRKVLFL

SEQ ID NO: 327 - protein, 8 aa, HIV-1
KVLFLDGI

SEQ ID NO: 328 - protein, 8 aa, HIV-1
LFLDGIDK

SEQ ID NO: 329 - protein, 8 aa, HIV-1
FLDGIDKA

SEQ ID NO: 330 - protein, 8 aa, HIV-1
KAQDEHEK

SEQ ID NO: 331 - protein, 8 aa, HIV-1
EKYHSNWR

SEQ ID NO: 332 - protein, 8 aa, HIV-1
YHSNWRAM

SEQ ID NO: 333 - protein, 8 aa, HIV-1
AMASDFNL

SEQ ID NO: 334 - protein, 8 aa, HIV-1
NLPPVVAK

SEQ ID NO: 335 - protein, 8 aa, HIV-1
PPVVAKEI

SEQ ID NO: 336 - protein, 8 aa, HIV-1
PVVAKEIV

SEQ ID NO: 337 - protein, 8 aa, HIV-1
EIVASCDK

SEQ ID NO: 338 - protein, 8 aa, HIV-1
CQLKGEAM

SEQ ID NO: 339 - protein, 8 aa, HIV-1
GEAMHGQV

SEQ ID NO: 340 - protein, 8 aa, HIV-1
AMHGQVDC

SEQ ID NO: 341 - protein, 8 aa, HIV-1
QVDCSPGI

SEQ ID NO: 342 - protein, 8 aa, HIV-1
CSPGIWQL

SEQ ID NO: 343 - protein, 8 aa, HIV-1
WQLDCTHL

SEQ ID NO: 344 - protein, 8 aa, HIV-1
HLEGKVIL

SEQ ID NO: 345 - protein, 8 aa, HIV-1
VILVAVHV

SEQ ID NO: 346 - protein, 8 aa, HIV-1
ILVAVHVA

SEQ ID NO: 347 - protein, 8 aa, HIV-1
AVHVASGY

SEQ ID NO: 348 - protein, 8 aa, HIV-1
GYIEAEVI

SEQ ID NO: 349 - protein, 8 aa, HIV-1
AEVIPAET

SEQ ID NO: 350 - protein, 8 aa, HIV-1
AETGQETA

SEQ ID NO: 351 - protein, 8 aa, HIV-1
ETGQETAY

SEQ ID NO: 352 - protein, 8 aa, HIV-1
GQETAYFL

SEQ ID NO: 353 - protein, 8 aa, HIV-1
QETAYFLL

SEQ ID NO: 354 - protein, 8 aa, HIV-1
ETAYFLLK

SEQ ID NO: 355 - protein, 8 aa, HIV-1
FLLKLAGR

SEQ ID NO: 356 - protein, 8 aa, HIV-1
KLAGRWPV

SEQ ID NO: 357 - protein, 8 aa, HIV-1
LAGRWPVK

SEQ ID NO: 358 - protein, 8 aa, HIV-1
GRWPVKTI

SEQ ID NO: 359 - protein, 8 aa, HIV-1
WPVKTIHT

SEQ ID NO: 360 - protein, 8 aa, HIV-1
HTDNGSNF

SEQ ID NO: 361 - protein, 8 aa, HIV-1
NFTGATVR

SEQ ID NO: 362 - protein, 8 aa, HIV-1
FTGATVRA

SEQ ID NO: 363 - protein, 8 aa, HIV-1
TGATVRAA

SEQ ID NO: 364 - protein, 8 aa, HIV-1
ATVRAACW

SEQ ID NO: 365 - protein, 8 aa, HIV-1
AACWWAGI

SEQ ID NO: 366 - protein, 8 aa, HIV-1
WAGIKQEF

SEQ ID NO: 367 - protein, 8 aa, HIV-1
GIKQEFGI

SEQ ID NO: 368 - protein, 8 aa, HIV-1
KQEFGIPY

SEQ ID NO: 369 - protein, 8 aa, HIV-1
NPQSQGVV

SEQ ID NO: 370 - protein, 8 aa, HIV-1
SQGVVESM

SEQ ID NO: 371 - protein, 8 aa, HIV-1
GVVESMNK

SEQ ID NO: 372 - protein, 8 aa, HIV-1
VESMNKEL

SEQ ID NO: 373 - protein, 8 aa, HIV-1
ESMNKELK

SEQ ID NO: 374 - protein, 8 aa, HIV-1
SMNKELKK

SEQ ID NO: 375 - protein, 8 aa, HIV-1
AEHLKTAV

SEQ ID NO: 376 - protein, 8 aa, HIV-1
KTAVQMAV

SEQ ID NO: 377 - protein, 8 aa, HIV-1
TAVQMAVF

SEQ ID NO: 378 - protein, 8 aa, HIV-1
VQMAVFIH

SEQ ID NO: 379 - protein, 8 aa, HIV-1
MAVFIHNF

SEQ ID NO: 380 - protein, 8 aa, HIV-1
AVFIHNFK

SEQ ID NO: 381 - protein, 8 aa, HIV-1
VFIHNFKR

SEQ ID NO: 382 - protein, 8 aa, HIV-1
FIHNFKRK

SEQ ID NO: 383 - protein, 8 aa, HIV-1
YSAGERIV

SEQ ID NO: 384 - protein, 8 aa, HIV-1
RIVDIIAT

SEQ ID NO: 385 - protein, 8 aa, HIV-1
IATDIQTK

SEQ ID NO: 386 - protein, 8 aa, HIV-1
IQTKELQK

SEQ ID NO: 387 - protein, 8 aa, HIV-1
LQKQITKI

SEQ ID NO: 388 - protein, 8 aa, HIV-1
QITKIQNF

SEQ ID NO: 389 - protein, 8 aa, HIV-1
ITKIQNFR

SEQ ID NO: 390 - protein, 8 aa, HIV-1
TKIQNFRV

SEQ ID NO: 391 - protein, 8 aa, HIV-1
KIQNFRVY

SEQ ID NO: 392 - protein, 8 aa, HIV-1
IQNFRVYY

SEQ ID NO: 393 - protein, 8 aa, HIV-1
QNFRVYYR

SEQ ID NO: 394 - protein, 8 aa, HIV-1
RVYYRDSR

SEQ ID NO: 395 - protein, 8 aa, HIV-1
YRDSRNPL

SEQ ID NO: 396 - protein, 8 aa, HIV-1
NPLWKGPA

SEQ ID NO: 397 - protein, 8 aa, HIV-1
KGPAKLLW

SEQ ID NO: 398 - protein, 8 aa, HIV-1
LLWKGEGA

SEQ ID NO: 399 - protein, 8 aa, HIV-1
VIQDNSDI

SEQ ID NO: 400 - protein, 8 aa, HIV-1
DIKVVPRR

SEQ ID NO: 401 - protein, 8 aa, HIV-1
VVPRRKAK

SEQ ID NO: 402 - protein, 8 aa, HIV-1
VPRRKAKI

SEQ ID NO: 403 - protein, 8 aa, HIV-1
RRKAKIIR

SEQ ID NO: 404 - protein, 8 aa, HIV-1
KIIRDYGK

SEQ ID NO: 405 - protein, 8 aa, HIV-1
KQMAGDDC

SEQ ID NO: 406 - protein, 8 aa, HIV-1
QMAGDDCV

SEQ ID NO: 407 - protein, 9 aa, HIV-1
VLSGGELDR

SEQ ID NO: 408 - protein, 9 aa, HIV-1
LSGGELDRW

SEQ ID NO: 409 - protein, 9 aa, HIV-1
DRWEKIRLR

SEQ ID NO: 410 - protein, 9 aa, HIV-1
KIRLRPGGK

SEQ ID NO: 411 - protein, 9 aa, HIV-1
RLRPGGKKK

SEQ ID NO: 412 - protein, 9 aa, HIV-1
GGKKKYKLK

SEQ ID NO: 413 - protein, 9 aa, HIV-1
KKYKLKHIV

SEQ ID NO: 414 - protein, 9 aa, HIV-1
KYKLKHIVW

SEQ ID NO: 415 - protein, 9 aa, HIV-1
KLKHIVWAS

SEQ ID NO: 416 - protein, 9 aa, HIV-1
HIVWASREL

SEQ ID NO: 417 - protein, 9 aa, HIV-1
WASRELERF

SEQ ID NO: 418 - protein, 9 aa, HIV-1
ERFAVNPGL

SEQ ID NO: 419 - protein, 9 aa, HIV-1
RFAVNPGLL

SEQ ID NO: 420 - protein, 9 aa, HIV-1
AVNPGLLET

SEQ ID NO: 421 - protein, 9 aa, HIV-1
GLLETSEGC

SEQ ID NO: 422 - protein, 9 aa, HIV-1
ETSEGCRQI

SEQ ID NO: 423 - protein, 9 aa, HIV-1
ILGQLQPSL

SEQ ID NO: 424 - protein, 9 aa, HIV-1
GQLQPSLQT

SEQ ID NO: 425 - protein, 9 aa, HIV-1
SLQTGSEEL

SEQ ID NO: 426 - protein, 9 aa, HIV-1
LQTGSEELR

SEQ ID NO: 427 - protein, 9 aa, HIV-1
GSEELRSLY

SEQ ID NO: 428 - protein, 9 aa, HIV-1
ELRSLYNTV

SEQ ID NO: 429 - protein, 9 aa, HIV-1
SLYNTVATL

SEQ ID NO: 430 - protein, 9 aa, HIV-1
LYNTVATLY

SEQ ID NO: 431 - protein, 9 aa, HIV-1
NTVATLYCV

SEQ ID NO: 432 - protein, 9 aa, HIV-1
ATLYCVHQR

SEQ ID NO: 433 - protein, 9 aa, HIV-1
TLYCVHQRI

SEQ ID NO: 434 - protein, 9 aa, HIV-1
YCVHQRIEI

SEQ ID NO: 435 - protein, 9 aa, HIV-1
CVHQRIEIK

SEQ ID NO: 436 - protein, 9 aa, HIV-1
QRIEIKDTK

SEQ ID NO: 437 - protein, 9 aa, HIV-1
EIKDTKEAL

SEQ ID NO: 438 - protein, 9 aa, HIV-1
ALDKIEEEQ

SEQ ID NO: 439 - protein, 9 aa, HIV-1
QQAAADTGH

SEQ ID NO: 440 - protein, 9 aa, HIV-1
HSNQVSQNY

SEQ ID NO: 441 - protein, 9 aa, HIV-1
NQVSQNYPI

SEQ ID NO: 442 - protein, 9 aa, HIV-1
QVSQNYPIV

SEQ ID NO: 443 - protein, 9 aa, HIV-1
QNYPIVQNI

SEQ ID NO: 444 - protein, 9 aa, HIV-1
VQNIQGQMV

SEQ ID NO: 445 - protein, 9 aa, HIV-1
IQGQMVHQA

SEQ ID NO: 446 - protein, 9 aa, HIV-1
MVHQAISPR

SEQ ID NO: 447 - protein, 9 aa, HIV-1
HQAISPRTL

SEQ ID NO: 448 - protein, 9 aa, HIV-1
AISPRTLNA

SEQ ID NO: 449 - protein, 9 aa, HIV-1
ISPRTLNAW

SEQ ID NO: 450 - protein, 9 aa, HIV-1
SPRTLNAWV

SEQ ID NO: 451 - protein, 9 aa, HIV-1
RTLNAWVKV

SEQ ID NO: 452 - protein, 9 aa, HIV-1
TLNAWVKVV

SEQ ID NO: 453 - protein, 9 aa, HIV-1
AWVKVVEEK

SEQ ID NO: 454 - protein, 9 aa, HIV-1
EEKAFSPEV

SEQ ID NO: 455 - protein, 9 aa, HIV-1
EKAFSPEVI

SEQ ID NO: 456 - protein, 9 aa, HIV-1
FSPEVIPMF

SEQ ID NO: 457 - protein, 9 aa, HIV-1
EVIPMFSAL

SEQ ID NO: 458 - protein, 9 aa, HIV-1
IPMFSALSE

SEQ ID NO: 459 - protein, 9 aa, HIV-1
ALSEGATPQ

SEQ ID NO: 460 - protein, 9 aa, HIV-1
SEGATPQDL

SEQ ID NO: 461 - protein, 9 aa, HIV-1
ATPQDLNTM

SEQ ID NO: 462 - protein, 9 aa, HIV-1
TPQDLNTML

SEQ ID NO: 463 - protein, 9 aa, HIV-1
DLNTMLNTV

SEQ ID NO: 464 - protein, 9 aa, HIV-1
NTVGGHQAA

SEQ ID NO: 465 - protein, 9 aa, HIV-1
TVGGHQAAM

SEQ ID NO: 466 - protein, 9 aa, HIV-1
HQAAMQMLK

SEQ ID NO: 467 - protein, 9 aa, HIV-1
AMQMLKETI

SEQ ID NO: 468 - protein, 9 aa, HIV-1
ETINEEAAE

SEQ ID NO: 469 - protein, 9 aa, HIV-1
TINEEAAEW

SEQ ID NO: 470 - protein, 9 aa, HIV-1
EEAAEWDRV

SEQ ID NO: 471 - protein, 9 aa, HIV-1
EAAEWDRVH

SEQ ID NO: 472 - protein, 9 aa, HIV-1
AEWDRVHPV

SEQ ID NO: 473 - protein, 9 aa, HIV-1
RVHPVHAGP

SEQ ID NO: 474 - protein, 9 aa, HIV-1
HPVHAGPIA

SEQ ID NO: 475 - protein, 9 aa, HIV-1
DIAGTTSTL

SEQ ID NO: 476 - protein, 9 aa, HIV-1
TTSTLQEQI

SEQ ID NO: 477 - protein, 9 aa, HIV-1
STLQEQIGW

SEQ ID NO: 478 - protein, 9 aa, HIV-1
TLQEQIGWM

SEQ ID NO: 479 - protein, 9 aa, HIV-1
GWMTNNPPI

SEQ ID NO: 480 - protein, 9 aa, HIV-1
MTNNPPIPV

SEQ ID NO: 481 - protein, 9 aa, HIV-1
NPPIPVGEI

SEQ ID NO: 482 - protein, 9 aa, HIV-1
PPIPVGEIY

SEQ ID NO: 483 - protein, 9 aa, HIV-1
IPVGEIYKR

SEQ ID NO: 484 - protein, 9 aa, HIV-1
GEIYKRWII

SEQ ID NO: 485 - protein, 9 aa, HIV-1
EIYKRWIIL

SEQ ID NO: 486 - protein, 9 aa, HIV-1
YKRWIILGL

SEQ ID NO: 487 - protein, 9 aa, HIV-1
RWIILGLNK

SEQ ID NO: 488 - protein, 9 aa, HIV-1
WIILGLNKI

SEQ ID NO: 489 - protein, 9 aa, HIV-1
IILGLNKIV

SEQ ID NO: 490 - protein, 9 aa, HIV-1
GLNKIVRMY

SEQ ID NO: 491 - protein, 9 aa, HIV-1
KIVRMYSPT

SEQ ID NO: 492 - protein, 9 aa, HIV-1
IVRMYSPTS

SEQ ID NO: 493 - protein, 9 aa, HIV-1
RMYSPTSIL

SEQ ID NO: 494 - protein, 9 aa, HIV-1
SPTSILDIR

SEQ ID NO: 495 - protein, 9 aa, HIV-1
SILDIRQGP

SEQ ID NO: 496 - protein, 9 aa, HIV-1
ILDIRQGPK

SEQ ID NO: 497 - protein, 9 aa, HIV-1
RQGPKEPFR

SEQ ID NO: 498 - protein, 9 aa, HIV-1
EPFRDYVDR

SEQ ID NO: 499 - protein, 9 aa, HIV-1
PFRDYVDRF

SEQ ID NO: 500 - protein, 9 aa, HIV-1
RDYVDRFYK

SEQ ID NO: 501 - protein, 9 aa, HIV-1
DYVDRFYKT

SEQ ID NO: 502 - protein, 9 aa, HIV-1
YVDRFYKTL

SEQ ID NO: 503 - protein, 9 aa, HIV-1
VDRFYKTLR

SEQ ID NO: 504 - protein, 9 aa, HIV-1
RAEQASQEV

SEQ ID NO: 505 - protein, 9 aa, HIV-1
QASQEVKNW

SEQ ID NO: 506 - protein, 9 aa, HIV-1
EVKNWMTET

SEQ ID NO: 507 - protein, 9 aa, HIV-1
NWMTETLLV

SEQ ID NO: 508 - protein, 9 aa, HIV-1
WMTETLLVQ

SEQ ID NO: 509 - protein, 9 aa, HIV-1
VQNANPDCK

SEQ ID NO: 510 - protein, 9 aa, HIV-1
TILKALGPA

SEQ ID NO: 511 - protein, 9 aa, HIV-1
ILKALGPAA

SEQ ID NO: 512 - protein, 9 aa, HIV-1
KALGPAATL

SEQ ID NO: 513 - protein, 9 aa, HIV-1
GPAATLEEM

SEQ ID NO: 514 - protein, 9 aa, HIV-1
ATLEEMMTA

SEQ ID NO: 515 - protein, 9 aa, HIV-1
TLEEMMTAC

SEQ ID NO: 516 - protein, 9 aa, HIV-1
EEMMTACQG

SEQ ID NO: 517 - protein, 9 aa, HIV-1
EMMTACQGV

SEQ ID NO: 518 - protein, 9 aa, HIV-1
GVGGPGHKA

SEQ ID NO: 519 - protein, 9 aa, HIV-1
GGPGHKARV

SEQ ID NO: 520 - protein, 9 aa, HIV-1
GPGHKARVL

SEQ ID NO: 521 - protein, 9 aa, HIV-1
KARVLAEAM

SEQ ID NO: 522 - protein, 9 aa, HIV-1
VLAEAMSQV

SEQ ID NO: 523 - protein, 9 aa, HIV-1
LAEAMSQVT

SEQ ID NO: 524 - protein, 9 aa, HIV-1
AEAMSQVTN

SEQ ID NO: 525 - protein, 9 aa, HIV-1
AMSQVTNSA

SEQ ID NO: 526 - protein, 9 aa, HIV-1
SQVTNSATI

SEQ ID NO: 527 - protein, 9 aa, HIV-1
QVTNSATIM

SEQ ID NO: 528 - protein, 9 aa, HIV-1
VTNSATIMM

SEQ ID NO: 529 - protein, 9 aa, HIV-1
NSATIMMQR

SEQ ID NO: 530 - protein, 9 aa, HIV-1
IMMQRGNFR

SEQ ID NO: 531 - protein, 9 aa, HIV-1
MMQRGNFRN

SEQ ID NO: 532 - protein, 9 aa, HIV-1
RGNFRNQRK

SEQ ID NO: 533 - protein, 9 aa, HIV-1
FRNQRKIVK

SEQ ID NO: 534 - protein, 9 aa, HIV-1
NQRKIVKCF

SEQ ID NO: 535 - protein, 9 aa, HIV-1
IVKCFNCGK

SEQ ID NO: 536 - protein, 9 aa, HIV-1
EGHTARNCR

SEQ ID NO: 537 - protein, 9 aa, HIV-1
TARNCRAPR

SEQ ID NO: 538 - protein, 9 aa, HIV-1
ARNCRAPRK

SEQ ID NO: 539 - protein, 9 aa, HIV-1
RNCRAPRKK

SEQ ID NO: 540 - protein, 9 aa, HIV-1
APRKKGCWK

SEQ ID NO: 541 - protein, 9 aa, HIV-1
HQMKDCTER

SEQ ID NO: 542 - protein, 9 aa, HIV-1
TERQANFLR

SEQ ID NO: 543 - protein, 9 aa, HIV-1
NFLREDLAF

SEQ ID NO: 544 - protein, 9 aa, HIV-1
FLREDLAFL

SEQ ID NO: 545 - protein, 9 aa, HIV-1
LAFLQGKAR

SEQ ID NO: 546 - protein, 9 aa, HIV-1
FLQGKAREF

SEQ ID NO: 547 - protein, 9 aa, HIV-1
KAREFSSEQ

SEQ ID NO: 548 - protein, 9 aa, HIV-1
REFSSEQTR

SEQ ID NO: 549 - protein, 9 aa, HIV-1
QTRANSPTR

SEQ ID NO: 550 - protein, 9 aa, HIV-1
SPTRRELQV

SEQ ID NO: 551 - protein, 9 aa, HIV-1
PTRRELQVW

SEQ ID NO: 552 - protein, 9 aa, HIV-1
RRELQVWGR

SEQ ID NO: 553 - protein, 9 aa, HIV-1
ADRQGTVSF

SEQ ID NO: 554 - protein, 9 aa, HIV-1
RQGTVSFNF

SEQ ID NO: 555 - protein, 9 aa, HIV-1
TVSFNFPQV

SEQ ID NO: 556 - protein, 9 aa, HIV-1
FNFPQVTLW

SEQ ID NO: 557 - protein, 9 aa, HIV-1
FPQVTLWQR

SEQ ID NO: 558 - protein, 9 aa, HIV-1
VTLWQRPLV

SEQ ID NO: 559 - protein, 9 aa, HIV-1
TLWQRPLVT

SEQ ID NO: 560 - protein, 9 aa, HIV-1
LWQRPLVTI

SEQ ID NO: 561 - protein, 9 aa, HIV-1
WQRPLVTIK

SEQ ID NO: 562 - protein, 9 aa, HIV-1
TIKIGGQLK

SEQ ID NO: 563 - protein, 9 aa, HIV-1
QLKEALLDT

SEQ ID NO: 564 - protein, 9 aa, HIV-1
DTVLEEMSL

SEQ ID NO: 565 - protein, 9 aa, HIV-1
EEMSLPGRW

SEQ ID NO: 566 - protein, 9 aa, HIV-1
EMSLPGRWK

SEQ ID NO: 567 - protein, 9 aa, HIV-1
SLPGRWKPK

SEQ ID NO: 568 - protein, 9 aa, HIV-1
LPGRWKPKM

SEQ ID NO: 569 - protein, 9 aa, HIV-1
KMIGGIGGF

SEQ ID NO: 570 - protein, 9 aa, HIV-1
MIGGIGGFI

SEQ ID NO: 571 - protein, 9 aa, HIV-1
GGIGGFIKV

SEQ ID NO: 572 - protein, 9 aa, HIV-1
KVRQYDQIL

SEQ ID NO: 573 - protein, 9 aa, HIV-1
RQYDQILIE

SEQ ID NO: 574 - protein, 9 aa, HIV-1
QYDQILIEI

SEQ ID NO: 575 - protein, 9 aa, HIV-1
ILIEICGHK

SEQ ID NO: 576 - protein, 9 aa, HIV-1
IEICGHKAI

SEQ ID NO: 577 - protein, 9 aa, HIV-1
HKAIGTVLV

SEQ ID NO: 578 - protein, 9 aa, HIV-1
TVLVGPTPV

SEQ ID NO: 579 - protein, 9 aa, HIV-1
LVGPTPVNI

SEQ ID NO: 580 - protein, 9 aa, HIV-1
LLTQIGCTL

SEQ ID NO: 581 - protein, 9 aa, HIV-1
TQIGCTLNF

SEQ ID NO: 582 - protein, 9 aa, HIV-1
TLNFPISPI

SEQ ID NO: 583 - protein, 9 aa, HIV-1
FPISPIETV

SEQ ID NO: 584 - protein, 9 aa, HIV-1
SPIETVPVK

SEQ ID NO: 585 - protein, 9 aa, HIV-1
VPVKLKPGM

SEQ ID NO: 586 - protein, 9 aa, HIV-1
GMDGPKVKQ

SEQ ID NO: 587 - protein, 9 aa, HIV-1
GPKVKQWPL

SEQ ID NO: 588 - protein, 9 aa, HIV-1
KQWPLTEEK

SEQ ID NO: 589 - protein, 9 aa, HIV-1
QWPLTEEKI

SEQ ID NO: 590 - protein, 9 aa, HIV-1
PLTEEKIKA

SEQ ID NO: 591 - protein, 9 aa, HIV-1
LTEEKIKAL

SEQ ID NO: 592 - protein, 9 aa, HIV-1
ALVEICTEM

SEQ ID NO: 593 - protein, 9 aa, HIV-1
CTEMEKEGK

SEQ ID NO: 594 - protein, 9 aa, HIV-1
PENPYNTPV

SEQ ID NO: 595 - protein, 9 aa, HIV-1
NPYNTPVFA

SEQ ID NO: 596 - protein, 9 aa, HIV-1
PYNTPVFAI

SEQ ID NO: 597 - protein, 9 aa, HIV-1
YNTPVFAIK

SEQ ID NO: 598 - protein, 9 aa, HIV-1
NTPVFAIKK

SEQ ID NO: 599 - protein, 9 aa, HIV-1
TPVFAIKKK

SEQ ID NO: 600 - protein, 9 aa, HIV-1
FAIKKKDST

SEQ ID NO: 601 - protein, 9 aa, HIV-1
AIKKKDSTK

SEQ ID NO: 602 - protein, 9 aa, HIV-1
KWRKLVDFR

SEQ ID NO: 603 - protein, 9 aa, HIV-1
KLVDFRELN

SEQ ID NO: 604 - protein, 9 aa, HIV-1
LVDFRELNK

SEQ ID NO: 605 - protein, 9 aa, HIV-1
ELNKRTQDF

SEQ ID NO: 606 - protein, 9 aa, HIV-1
KRTQDFWEV

SEQ ID NO: 607 - protein, 9 aa, HIV-1
RTQDFWEVQ

SEQ ID NO: 608 - protein, 9 aa, HIV-1
TQDFWEVQL

SEQ ID NO: 609 - protein, 9 aa, HIV-1
DFWEVQLGI

SEQ ID NO: 610 - protein, 9 aa, HIV-1
WEVQLGIPH

SEQ ID NO: 611 - protein, 9 aa, HIV-1
VQLGIPHPA

SEQ ID NO: 612 - protein, 9 aa, HIV-1
LGIPHPAGL

SEQ ID NO: 613 - protein, 9 aa, HIV-1
GIPHPAGLK

SEQ ID NO: 614 - protein, 9 aa, HIV-1
IPHPAGLKK

SEQ ID NO: 615 - protein, 9 aa, HIV-1
TVLDVGDAY

SEQ ID NO: 616 - protein, 9 aa, HIV-1
VLDVGDAYF

SEQ ID NO: 617 - protein, 9 aa, HIV-1
DVGDAYFSV

SEQ ID NO: 618 - protein, 9 aa, HIV-1
FSVPLDEDF

SEQ ID NO: 619 - protein, 9 aa, HIV-1
SVPLDEDFR

SEQ ID NO: 620 - protein, 9 aa, HIV-1
EDFRKYTAF

SEQ ID NO: 621 - protein, 9 aa, HIV-1
DFRKYTAFT

SEQ ID NO: 622 - protein, 9 aa, HIV-1
YTAFTIPSI

SEQ ID NO: 623 - protein, 9 aa, HIV-1
FTIPSINNE

SEQ ID NO: 624 - protein, 9 aa, HIV-1
TIPSINNET

SEQ ID NO: 625 - protein, 9 aa, HIV-1
SINNETPGI

SEQ ID NO: 626 - protein, 9 aa, HIV-1
ETPGIRYQY

SEQ ID NO: 627 - protein, 9 aa, HIV-1
YQYNVLPQG

SEQ ID NO: 628 - protein, 9 aa, HIV-1
QYNVLPQGW

SEQ ID NO: 629 - protein, 9 aa, HIV-1
VLPQGWKGS

SEQ ID NO: 630 - protein, 9 aa, HIV-1
QGWKGSPAI

SEQ ID NO: 631 - protein, 9 aa, HIV-1
GWKGSPAIF

SEQ ID NO: 632 - protein, 9 aa, HIV-1
SPAIFQSSM

SEQ ID NO: 633 - protein, 9 aa, HIV-1
AIFQSSMTK

SEQ ID NO: 634 - protein, 9 aa, HIV-1
IFQSSMTKI

SEQ ID NO: 635 - protein, 9 aa, HIV-1
FQSSMTKIL

SEQ ID NO: 636 - protein, 9 aa, HIV-1
SMTKILEPF

SEQ ID NO: 637 - protein, 9 aa, HIV-1
MTKILEPFR

SEQ ID NO: 638 - protein, 9 aa, HIV-1
KQNPDIVIY

SEQ ID NO: 639 - protein, 9 aa, HIV-1
NPDIVIYQY

SEQ ID NO: 640 - protein, 9 aa, HIV-1
VIYQYMDDL

SEQ ID NO: 641 - protein, 9 aa, HIV-1
IYQYMDDLY

SEQ ID NO: 642 - protein, 9 aa, HIV-1
YQYMDDLYV

SEQ ID NO: 643 - protein, 9 aa, HIV-1
YMDDLYVGS

SEQ ID NO: 644 - protein, 9 aa, HIV-1
LYVGSDLEI

SEQ ID NO: 645 - protein, 9 aa, HIV-1
DLEIGQHRT

SEQ ID NO: 646 - protein, 9 aa, HIV-1
HRTKIEELR

SEQ ID NO: 647 - protein, 9 aa, HIV-1
KIEELRQHL

SEQ ID NO: 648 - protein, 9 aa, HIV-1
IEELRQHLL

SEQ ID NO: 649 - protein, 9 aa, HIV-1
ELRQHLLRW

SEQ ID NO: 650 - protein, 9 aa, HIV-1
RQHLLRWGL

SEQ ID NO: 651 - protein, 9 aa, HIV-1
HLLRWGLTT

SEQ ID NO: 652 - protein, 9 aa, HIV-1
LLRWGLTTP

SEQ ID NO: 653 - protein, 9 aa, HIV-1
RWGLTTPDK

SEQ ID NO: 654 - protein, 9 aa, HIV-1
TTPDKKHQK

SEQ ID NO: 655 - protein, 9 aa, HIV-1
EPPFLWMGY

SEQ ID NO: 656 - protein, 9 aa, HIV-1
PFLWMGYEL

SEQ ID NO: 657 - protein, 9 aa, HIV-1
FLWMGYELH

SEQ ID NO: 658 - protein, 9 aa, HIV-1
MGYELHPDK

SEQ ID NO: 659 - protein, 9 aa, HIV-1
GYELHPDKW

SEQ ID NO: 660 - protein, 9 aa, HIV-1
YELHPDKWT

SEQ ID NO: 661 - protein, 9 aa, HIV-1
ELHPDKWTV

SEQ ID NO: 662 - protein, 9 aa, HIV-1
KWTVQPIVL

SEQ ID NO: 663 - protein, 9 aa, HIV-1
VQPIVLPEK

SEQ ID NO: 664 - protein, 9 aa, HIV-1
IVLPEKDSW

SEQ ID NO: 665 - protein, 9 aa, HIV-1
VLPEKDSWT

SEQ ID NO: 666 - protein, 9 aa, HIV-1
LPEKDSWTV

SEQ ID NO: 667 - protein, 9 aa, HIV-1
SWTVNDIQK

SEQ ID NO: 668 - protein, 9 aa, HIV-1
WTVNDIQKL

SEQ ID NO: 669 - protein, 9 aa, HIV-1
TVNDIQKLV

SEQ ID NO: 670 - protein, 9 aa, HIV-1
KLVGKLNWA

SEQ ID NO: 671 - protein, 9 aa, HIV-1
KLNWASQIY

SEQ ID NO: 672 - protein, 9 aa, HIV-1
WASQIYPGI

SEQ ID NO: 673 - protein, 9 aa, HIV-1
ASQIYPGIK

SEQ ID NO: 674 - protein, 9 aa, HIV-1
SQIYPGIKV

SEQ ID NO: 675 - protein, 9 aa, HIV-1
QIYPGIKVR

SEQ ID NO: 676 - protein, 9 aa, HIV-1
YPGIKVRQL

SEQ ID NO: 677 - protein, 9 aa, HIV-1
GIKVRQLCK

SEQ ID NO: 678 - protein, 9 aa, HIV-1
LCKLLRGTK

SEQ ID NO: 679 - protein, 9 aa, HIV-1
KLLRGTKAL

SEQ ID NO: 680 - protein, 9 aa, HIV-1
LLRGTKALT

SEQ ID NO: 681 - protein, 9 aa, HIV-1
KALTEVIPL

SEQ ID NO: 682 - protein, 9 aa, HIV-1
ALTEVIPLT

SEQ ID NO: 683 - protein, 9 aa, HIV-1
EVIPLTEEA

SEQ ID NO: 684 - protein, 9 aa, HIV-1
IPLTEEAEL

SEQ ID NO: 685 - protein, 9 aa, HIV-1
EEAELELAE

SEQ ID NO: 686 - protein, 9 aa, HIV-1
ELAENREIL

SEQ ID NO: 687 - protein, 9 aa, HIV-1
LAENREILK

SEQ ID NO: 688 - protein, 9 aa, HIV-1
ILKEPVHGV

SEQ ID NO: 689 - protein, 9 aa, HIV-1
KEPVHGVYY

SEQ ID NO: 690 - protein, 9 aa, HIV-1
HGVYYDPSK

SEQ ID NO: 691 - protein, 9 aa, HIV-1
VYYDPSKDL

SEQ ID NO: 692 - protein, 9 aa, HIV-1
YYDPSKDLI

SEQ ID NO: 693 - protein, 9 aa, HIV-1
IQKQGQGQW

SEQ ID NO: 694 - protein, 9 aa, HIV-1
KQGQGQWTY

SEQ ID NO: 695 - protein, 9 aa, HIV-1
GQGQWTYQI

SEQ ID NO: 696 - protein, 9 aa, HIV-1
TYQIYQEPF

SEQ ID NO: 697 - protein, 9 aa, HIV-1
YQIYQEPFK

SEQ ID NO: 698 - protein, 9 aa, HIV-1
IYQEPFKNL

SEQ ID NO: 699 - protein, 9 aa, HIV-1
NLKTGKYAR

SEQ ID NO: 700 - protein, 9 aa, HIV-1
KTGKYARMR

SEQ ID NO: 701 - protein, 9 aa, HIV-1
KYARMRGAH

SEQ ID NO: 702 - protein, 9 aa, HIV-1
YARMRGAHT

SEQ ID NO: 703 - protein, 9 aa, HIV-1
DVKQLTEAV

SEQ ID NO: 704 - protein, 9 aa, HIV-1
KQLTEAVQK

SEQ ID NO: 705 - protein, 9 aa, HIV-1
QLTEAVQKI

SEQ ID NO: 706 - protein, 9 aa, HIV-1
VQKITTESI

SEQ ID NO: 707 - protein, 9 aa, HIV-1
KITTESIVI

SEQ ID NO: 708 - protein, 9 aa, HIV-1
ITTESIVIW

SEQ ID NO: 709 - protein, 9 aa, HIV-1
ESIVIWGKT

SEQ ID NO: 710 - protein, 9 aa, HIV-1
IVIWGKTPK

SEQ ID NO: 711 - protein, 9 aa, HIV-1
IWGKTPKFK

SEQ ID NO: 712 - protein, 9 aa, HIV-1
KTPKFKLPI

SEQ ID NO: 713 - protein, 9 aa, HIV-1
IQKETWETW

SEQ ID NO: 714 - protein, 9 aa, HIV-1
ETWETWWTE

SEQ ID NO: 715 - protein, 9 aa, HIV-1
TWETWWTEY

SEQ ID NO: 716 - protein, 9 aa, HIV-1
WETWWTEYW

SEQ ID NO: 717 - protein, 9 aa, HIV-1
ETWWTEYWQ

SEQ ID NO: 718 - protein, 9 aa, HIV-1
WTEYWQATW

SEQ ID NO: 719 - protein, 9 aa, HIV-1
TEYWQATWI

SEQ ID NO: 720 - protein, 9 aa, HIV-1
WQATWIPEW

SEQ ID NO: 721 - protein, 9 aa, HIV-1
ATWIPEWEF

SEQ ID NO: 722 - protein, 9 aa, HIV-1
IPEWEFVNT

SEQ ID NO: 723 - protein, 9 aa, HIV-1
WEFVNTPPL

SEQ ID NO: 724 - protein, 9 aa, HIV-1
EFVNTPPLV

SEQ ID NO: 725 - protein, 9 aa, HIV-1
FVNTPPLVK

SEQ ID NO: 726 - protein, 9 aa, HIV-1
NTPPLVKLW

SEQ ID NO: 727 - protein, 9 aa, HIV-1
TPPLVKLWY

SEQ ID NO: 728 - protein, 9 aa, HIV-1
PLVKLWYQL

SEQ ID NO: 729 - protein, 9 aa, HIV-1
WYQLEKEPI

SEQ ID NO: 730 - protein, 9 aa, HIV-1
YQLEKEPIV

SEQ ID NO: 731 - protein, 9 aa, HIV-1
EPIVGAETF

SEQ ID NO: 732 - protein, 9 aa, HIV-1
PIVGAETFY

SEQ ID NO: 733 - protein, 9 aa, HIV-1
IVGAETFYV

SEQ ID NO: 734 - protein, 9 aa, HIV-1
AETFYVDGA

SEQ ID NO: 735 - protein, 9 aa, HIV-1
ETFYVDGAA

SEQ ID NO: 736 - protein, 9 aa, HIV-1
FYVDGAANR

SEQ ID NO: 737 - protein, 9 aa, HIV-1
ANRETKLGK

SEQ ID NO: 738 - protein, 9 aa, HIV-1
ETKLGKAGY

SEQ ID NO: 739 - protein, 9 aa, HIV-1
KLGKAGYVT

SEQ ID NO: 740 - protein, 9 aa, HIV-1
YVTNRGRQK

SEQ ID NO: 741 - protein, 9 aa, HIV-1
VTNRGRQKV

SEQ ID NO: 742 - protein, 9 aa, HIV-1
RGRQKVVTL

SEQ ID NO: 743 - protein, 9 aa, HIV-1
TLTDTTNQK

SEQ ID NO: 744 - protein, 9 aa, HIV-1
DTTNQKTEL

SEQ ID NO: 745 - protein, 9 aa, HIV-1
TTNQKTELQ

SEQ ID NO: 746 - protein, 9 aa, HIV-1
NQKTELQAI

SEQ ID NO: 747 - protein, 9 aa, HIV-1
ELQAIYLAL

SEQ ID NO: 748 - protein, 9 aa, HIV-1
LQAIYLALQ

SEQ ID NO: 749 - protein, 9 aa, HIV-1
YLALQDSGL

SEQ ID NO: 750 - protein, 9 aa, HIV-1
ALQDSGLEV

SEQ ID NO: 751 - protein, 9 aa, HIV-1
EVNIVTDSQ

SEQ ID NO: 752 - protein, 9 aa, HIV-1
IVTDSQYAL

SEQ ID NO: 753 - protein, 9 aa, HIV-1
YALGIIQAQ

SEQ ID NO: 754 - protein, 9 aa, HIV-1
AQPDQSESE

SEQ ID NO: 755 - protein, 9 aa, HIV-1
QPDQSESEL

SEQ ID NO: 756 - protein, 9 aa, HIV-1
SESELVNQI

SEQ ID NO: 757 - protein, 9 aa, HIV-1
ELVNQIIEQ

SEQ ID NO: 758 - protein, 9 aa, HIV-1
LVNQIIEQL

SEQ ID NO: 759 - protein, 9 aa, HIV-1
QIIEQLIKK

SEQ ID NO: 760 - protein, 9 aa, HIV-1
QLIKKEKVY

SEQ ID NO: 761 - protein, 9 aa, HIV-1
LIKKEKVYL

SEQ ID NO: 762 - protein, 9 aa, HIV-1
KEKVYLAWV

SEQ ID NO: 763 - protein, 9 aa, HIV-1
KVYLAWVPA

SEQ ID NO: 764 - protein, 9 aa, HIV-1
YLAWVPAHK

SEQ ID NO: 765 - protein, 9 aa, HIV-1
KGIGGNEQV

SEQ ID NO: 766 - protein, 9 aa, HIV-1
EQVDKLVSA

SEQ ID NO: 767 - protein, 9 aa, HIV-1
KLVSAGIRK

SEQ ID NO: 768 - protein, 9 aa, HIV-1
LVSAGIRKV

SEQ ID NO: 769 - protein, 9 aa, HIV-1
VLFLDGIDK

SEQ ID NO: 770 - protein, 9 aa, HIV-1
FLDGIDKAQ

SEQ ID NO: 771 - protein, 9 aa, HIV-1
KYHSNWRAM

SEQ ID NO: 772 - protein, 9 aa, HIV-1
NWRAMASDF

SEQ ID NO: 773 - protein, 9 aa, HIV-1
RAMASDFNL

SEQ ID NO: 774 - protein, 9 aa, HIV-1
ASDFNLPPV

SEQ ID NO: 775 - protein, 9 aa, HIV-1
LPPVVAKEI

SEQ ID NO: 776 - protein, 9 aa, HIV-1
PPVVAKEIV

SEQ ID NO: 777 - protein, 9 aa, HIV-1
ASCDKCQLK

SEQ ID NO: 778 - protein, 9 aa, HIV-1
GQVDCSPGI

SEQ ID NO: 779 - protein, 9 aa, HIV-1
DCSPGIWQL

SEQ ID NO: 780 - protein, 9 aa, HIV-1
IWQLDCTHL

SEQ ID NO: 781 - protein, 9 aa, HIV-1
WQLDCTHLE

SEQ ID NO: 782 - protein, 9 aa, HIV-1
THLEGKVIL

SEQ ID NO: 783 - protein, 9 aa, HIV-1
HLEGKVILV

SEQ ID NO: 784 - protein, 9 aa, HIV-1
EGKVILVAV

SEQ ID NO: 785 - protein, 9 aa, HIV-1
KVILVAVHV

SEQ ID NO: 786 - protein, 9 aa, HIV-1
VILVAVHVA

SEQ ID NO: 787 - protein, 9 aa, HIV-1
VAVHVASGY

SEQ ID NO: 788 - protein, 9 aa, HIV-1
AVHVASGYI

SEQ ID NO: 789 - protein, 9 aa, HIV-1
HVASGYIEA

SEQ ID NO: 790 - protein, 9 aa, HIV-1
YIEAEVIPA

SEQ ID NO: 791 - protein, 9 aa, HIV-1
AEVIPAETG

SEQ ID NO: 792 - protein, 9 aa, HIV-1
IPAETGQET

SEQ ID NO: 793 - protein, 9 aa, HIV-1
AETGQETAY

SEQ ID NO: 794 - protein, 9 aa, HIV-1
ETGQETAYF

SEQ ID NO: 795 - protein, 9 aa, HIV-1
GQETAYFLL

SEQ ID NO: 796 - protein, 9 aa, HIV-1
QETAYFLLK

SEQ ID NO: 797 - protein, 9 aa, HIV-1
ETAYFLLKL

SEQ ID NO: 798 - protein, 9 aa, HIV-1
YFLLKLAGR

SEQ ID NO: 799 - protein, 9 aa, HIV-1
LKLAGRWPV

SEQ ID NO: 800 - protein, 9 aa, HIV-1
KLAGRWPVK

SEQ ID NO: 801 - protein, 9 aa, HIV-1
GRWPVKTIH

SEQ ID NO: 802 - protein, 9 aa, HIV-1
WPVKTIHTD

SEQ ID NO: 803 - protein, 9 aa, HIV-1
HTDNGSNFT

SEQ ID NO: 804 - protein, 9 aa, HIV-1
SNFTGATVR

SEQ ID NO: 805 - protein, 9 aa, HIV-1
FTGATVRAA

SEQ ID NO: 806 - protein, 9 aa, HIV-1
GATVRAACW

SEQ ID NO: 807 - protein, 9 aa, HIV-1
ATVRAACWW

SEQ ID NO: 808 - protein, 9 aa, HIV-1
RAACWWAGI

SEQ ID NO: 809 - protein, 9 aa, HIV-1
AACWWAGIK

SEQ ID NO: 810 - protein, 9 aa, HIV-1
WWAGIKQEF

SEQ ID NO: 811 - protein, 9 aa, HIV-1
IKQEFGIPY

SEQ ID NO: 812 - protein, 9 aa, HIV-1
ESMNKELKK

SEQ ID NO: 813 - protein, 9 aa, HIV-1
SMNKELKKI

SEQ ID NO: 814 - protein, 9 aa, HIV-1
ELKKIIGQV

SEQ ID NO: 815 - protein, 9 aa, HIV-1
IIGQVRDQA

SEQ ID NO: 816 - protein, 9 aa, HIV-1
HLKTAVQMA

SEQ ID NO: 817 - protein, 9 aa, HIV-1
LKTAVQMAV

SEQ ID NO: 818 - protein, 9 aa, HIV-1
KTAVQMAVF

SEQ ID NO: 819 - protein, 9 aa, HIV-1
TAVQMAVFI

SEQ ID NO: 820 - protein, 9 aa, HIV-1
AVQMAVFIH

SEQ ID NO: 821 - protein, 9 aa, HIV-1
VQMAVFIHN

SEQ ID NO: 822 - protein, 9 aa, HIV-1
QMAVFIHNF

SEQ ID NO: 823 - protein, 9 aa, HIV-1
MAVFIHNFK

SEQ ID NO: 824 - protein, 9 aa, HIV-1
AVFIHNFKR

SEQ ID NO: 825 - protein, 9 aa, HIV-1
VFIHNFKRK

SEQ ID NO: 826 - protein, 9 aa, HIV-1
KRKGGIGGY

SEQ ID NO: 827 - protein, 9 aa, HIV-1
IIATDIQTK

SEQ ID NO: 828 - protein, 9 aa, HIV-1
ELQKQITKI

SEQ ID NO: 829 - protein, 9 aa, HIV-1
KQITKIQNF

SEQ ID NO: 830 - protein, 9 aa, HIV-1
QITKIQNFR

SEQ ID NO: 831 - protein, 9 aa, HIV-1
ITKIQNFRV

SEQ ID NO: 832 - protein, 9 aa, HIV-1
KIQNFRVYY

SEQ ID NO: 833 - protein, 9 aa, HIV-1
IQNFRVYYR

SEQ ID NO: 834 - protein, 9 aa, HIV-1
FRVYYRDSR

SEQ ID NO: 835 - protein, 9 aa, HIV-1
YYRDSRNPL

SEQ ID NO: 836 - protein, 9 aa, HIV-1
PLWKGPAKL

SEQ ID NO: 837 - protein, 9 aa, HIV-1
KLLWKGEGA

SEQ ID NO: 838 - protein, 9 aa, HIV-1
LLWKGEGAV

SEQ ID NO: 839 - protein, 9 aa, HIV-1
VIQDNSDIK

SEQ ID NO: 840 - protein, 9 aa, HIV-1
IQDNSDIKV

SEQ ID NO: 841 - protein, 9 aa, HIV-1
NSDIKVVPR

SEQ ID NO: 842 - protein, 9 aa, HIV-1
KVVPRRKAK

SEQ ID NO: 843 - protein, 9 aa, HIV-1
VPRRKAKII

SEQ ID NO: 844 - protein, 9 aa, HIV-1
KQMAGDDCV

SEQ ID NO: 845 - protein, 9 aa, HIV-1
QMAGDDCVA

SEQ ID NO: 846 - protein, 10 aa, HIV-1
RASVLSGGEL

SEQ ID NO: 847 - protein, 10 aa, HIV-1
SVLSGGELDR

SEQ ID NO: 848 - protein, 10 aa, HIV-1
VLSGGELDRW

SEQ ID NO: 849 - protein, 10 aa, HIV-1
ELDRWEKIRL

SEQ ID NO: 850 - protein, 10 aa, HIV-1
KIRLRPGGKK

SEQ ID NO: 851 - protein, 10 aa, HIV-1
RLRPGGKKKY

SEQ ID NO: 852 - protein, 10 aa, HIV-1
RPGGKKKYKL

SEQ ID NO: 853 - protein, 10 aa, HIV-1
KKYKLKHIVW

SEQ ID NO: 854 - protein, 10 aa, HIV-1
KLKHIVWASR

SEQ ID NO: 855 - protein, 10 aa, HIV-1
IVWASRELER

SEQ ID NO: 856 - protein, 10 aa, HIV-1
VWASRELERF

SEQ ID NO: 857 - protein, 10 aa, HIV-1
LERFAVNPGL

SEQ ID NO: 858 - protein, 10 aa, HIV-1
ERFAVNPGLL

SEQ ID NO: 859 - protein, 10 aa, HIV-1
FAVNPGLLET

SEQ ID NO: 860 - protein, 10 aa, HIV-1
ETSEGCRQIL

SEQ ID NO: 861 - protein, 10 aa, HIV-1
RQILGQLQPS

SEQ ID NO: 862 - protein, 10 aa, HIV-1
QILGQLQPSL

SEQ ID NO: 863 - protein, 10 aa, HIV-1
ILGQLQPSLQ

SEQ ID NO: 864 - protein, 10 aa, HIV-1
SLQTGSEELR

SEQ ID NO: 865 - protein, 10 aa, HIV-1
EELRSLYNTV

SEQ ID NO: 866 - protein, 10 aa, HIV-1
RSLYNTVATL

SEQ ID NO: 867 - protein, 10 aa, HIV-1
SLYNTVATLY

SEQ ID NO: 868 - protein, 10 aa, HIV-1
VATLYCVHQR

SEQ ID NO: 869 - protein, 10 aa, HIV-1
ATLYCVHQRI

SEQ ID NO: 870 - protein, 10 aa, HIV-1
LYCVHQRIEI

SEQ ID NO: 871 - protein, 10 aa, HIV-1
IEIKDTKEAL

SEQ ID NO: 872 - protein, 10 aa, HIV-1
AADTGHSNQV

SEQ ID NO: 873 - protein, 10 aa, HIV-1
NQVSQNYPIV

SEQ ID NO: 874 - protein, 10 aa, HIV-1
SQNYPIVQNI

SEQ ID NO: 875 - protein, 10 aa, HIV-1
PIVQNIQGQM

SEQ ID NO: 876 - protein, 10 aa, HIV-1
IVQNIQGQMV

SEQ ID NO: 877 - protein, 10 aa, HIV-1
VQNIQGQMVH

SEQ ID NO: 878 - protein, 10 aa, HIV-1
NIQGQMVHQA

SEQ ID NO: 879 - protein, 10 aa, HIV-1
IQGQMVHQAI

SEQ ID NO: 880 - protein, 10 aa, HIV-1
QMVHQAISPR

SEQ ID NO: 881 - protein, 10 aa, HIV-1
AISPRTLNAW

SEQ ID NO: 882 - protein, 10 aa, HIV-1
RTLNAWVKVV

SEQ ID NO: 883 - protein, 10 aa, HIV-1
NAWVKVVEEK

SEQ ID NO: 884 - protein, 10 aa, HIV-1
WVKVVEEKAF

SEQ ID NO: 885 - protein, 10 aa, HIV-1
VEEKAFSPEV

SEQ ID NO: 886 - protein, 10 aa, HIV-1
EEKAFSPEVI

SEQ ID NO: 887 - protein, 10 aa, HIV-1
KAFSPEVIPM

SEQ ID NO: 888 - protein, 10 aa, HIV-1
AFSPEVIPMF

SEQ ID NO: 889 - protein, 10 aa, HIV-1
PEVIPMFSAL

SEQ ID NO: 890 - protein, 10 aa, HIV-1
EVIPMFSALS

SEQ ID NO: 891 - protein, 10 aa, HIV-1
PMFSALSEGA

SEQ ID NO: 892 - protein, 10 aa, HIV-1
ATPQDLNTML

SEQ ID NO: 893 - protein, 10 aa, HIV-1
MLNTVGGHQA

SEQ ID NO: 894 - protein, 10 aa, HIV-1
NTVGGHQAAM

SEQ ID NO: 895 - protein, 10 aa, HIV-1
GHQAAMQMLK

SEQ ID NO: 896 - protein, 10 aa, HIV-1
AAMQMLKETI

SEQ ID NO: 897 - protein, 10 aa, HIV-1
MLKETINEEA

SEQ ID NO: 898 - protein, 10 aa, HIV-1
ETINEEAAEW

SEQ ID NO: 899 - protein, 10 aa, HIV-1
AAEWDRVHPV

SEQ ID NO: 900 - protein, 10 aa, HIV-1
RVHPVHAGPI

SEQ ID NO: 901 - protein, 10 aa, HIV-1
HPVHAGPIAP

SEQ ID NO: 902 - protein, 10 aa, HIV-1
IAPGQMREPR

SEQ ID NO: 903 - protein, 10 aa, HIV-1
TSTLQEQIGW

SEQ ID NO: 904 - protein, 10 aa, HIV-1
STLQEQIGWM

SEQ ID NO: 905 - protein, 10 aa, HIV-1
TLQEQIGWMT

SEQ ID NO: 906 - protein, 10 aa, HIV-1
WMTNNPPIPV

SEQ ID NO: 907 - protein, 10 aa, HIV-1
NPPIPVGEIY

SEQ ID NO: 908 - protein, 10 aa, HIV-1
IPVGEIYKRW

SEQ ID NO: 909 - protein, 10 aa, HIV-1
GEIYKRWIIL

SEQ ID NO: 910 - protein, 10 aa, HIV-1
IYKRWIILGL

SEQ ID NO: 911 - protein, 10 aa, HIV-1
KRWIILGLNK

SEQ ID NO: 912 - protein, 10 aa, HIV-1
RWIILGLNKI

SEQ ID NO: 913 - protein, 10 aa, HIV-1
WIILGLNKIV

SEQ ID NO: 914 - protein, 10 aa, HIV-1
IILGLNKIVR

SEQ ID NO: 915 - protein, 10 aa, HIV-1
ILGLNKIVRM

SEQ ID NO: 916 - protein, 10 aa, HIV-1
IVRMYSPTSI

SEQ ID NO: 917 - protein, 10 aa, HIV-1
MYSPTSILDI

SEQ ID NO: 918 - protein, 10 aa, HIV-1
YSPTSILDIR

SEQ ID NO: 919 - protein, 10 aa, HIV-1
SILDIRQGPK

SEQ ID NO: 920 - protein, 10 aa, HIV-1
DIRQGPKEPF

SEQ ID NO: 921 - protein, 10 aa, HIV-1
EPFRDYVDRF

SEQ ID NO: 922 - protein, 10 aa, HIV-1
DYVDRFYKTL

SEQ ID NO: 923 - protein, 10 aa, HIV-1
YVDRFYKTLR

SEQ ID NO: 924 - protein, 10 aa, HIV-1
RFYKTLRAEQ

SEQ ID NO: 925 - protein, 10 aa, HIV-1
RAEQASQEVK

SEQ ID NO: 926 - protein, 10 aa, HIV-1
EVKNWMTETL

SEQ ID NO: 927 - protein, 10 aa, HIV-1
WMTETLLVQN

SEQ ID NO: 928 - protein, 10 aa, HIV-1
LVQNANPDCK

SEQ ID NO: 929 - protein, 10 aa, HIV-1
KTILKALGPA

SEQ ID NO: 930 - protein, 10 aa, HIV-1
TILKALGPAA

SEQ ID NO: 931 - protein, 10 aa, HIV-1
ILKALGPAAT

SEQ ID NO: 932 - protein, 10 aa, HIV-1
GPAATLEEMM

SEQ ID NO: 933 - protein, 10 aa, HIV-1
ATLEEMMTAC

SEQ ID NO: 934 - protein, 10 aa, HIV-1
TLEEMMTACQ

SEQ ID NO: 935 - protein, 10 aa, HIV-1
EEMMTACQGV

SEQ ID NO: 936 - protein, 10 aa, HIV-1
VGGPGHKARV

SEQ ID NO: 937 - protein, 10 aa, HIV-1
RVLAEAMSQV

SEQ ID NO: 938 - protein, 10 aa, HIV-1
VLAEAMSQVT

SEQ ID NO: 939 - protein, 10 aa, HIV-1
AEAMSQVTNS

SEQ ID NO: 940 - protein, 10 aa, HIV-1
EAMSQVTNSA

SEQ ID NO: 941 - protein, 10 aa, HIV-1
AMSQVTNSAT

SEQ ID NO: 942 - protein, 10 aa, HIV-1
SQVTNSATIM

SEQ ID NO: 943 - protein, 10 aa, HIV-1
QVTNSATIMM

SEQ ID NO: 944 - protein, 10 aa, HIV-1
TNSATIMMQR

SEQ ID NO: 945 - protein, 10 aa, HIV-1
ATIMMQRGNF

SEQ ID NO: 946 - protein, 10 aa, HIV-1
TIMMQRGNFR

SEQ ID NO: 947 - protein, 10 aa, HIV-1
MMQRGNFRNQ

SEQ ID NO: 948 - protein, 10 aa, HIV-1
MQRGNFRNQR

SEQ ID NO: 949 - protein, 10 aa, HIV-1
NFRNQRKIVK

SEQ ID NO: 950 - protein, 10 aa, HIV-1
KIVKCFNCGK

SEQ ID NO: 951 - protein, 10 aa, HIV-1
KEGHTARNCR

SEQ ID NO: 952 - protein, 10 aa, HIV-1
HTARNCRAPR

SEQ ID NO: 953 - protein, 10 aa, HIV-1
TARNCRAPRK

SEQ ID NO: 954 - protein, 10 aa, HIV-1
ARNCRAPRKK

SEQ ID NO: 955 - protein, 10 aa, HIV-1
RAPRKKGCWK

SEQ ID NO: 956 - protein, 10 aa, HIV-1
APRKKGCWKC

SEQ ID NO: 957 - protein, 10 aa, HIV-1
RKKGCWKCGK

SEQ ID NO: 958 - protein, 10 aa, HIV-1
KCGKEGHQMK

SEQ ID NO: 959 - protein, 10 aa, HIV-1
QMKDCTERQA

SEQ ID NO: 960 - protein, 10 aa, HIV-1
CTERQANFLR

SEQ ID NO: 961 - protein, 10 aa, HIV-1
RQANFLREDL

SEQ ID NO: 962 - protein, 10 aa, HIV-1
NFLREDLAFL

SEQ ID NO: 963 - protein, 10 aa, HIV-1
FLREDLAFLQ

SEQ ID NO: 964 - protein, 10 aa, HIV-1
DLAFLQGKAR

SEQ ID NO: 965 - protein, 10 aa, HIV-1
AFLQGKAREF

SEQ ID NO: 966 - protein, 10 aa, HIV-1
REFSSEQTRA

SEQ ID NO: 967 - protein, 10 aa, HIV-1
EQTRANSPTR

SEQ ID NO: 968 - protein, 10 aa, HIV-1
QTRANSPTRR

SEQ ID NO: 969 - protein, 10 aa, HIV-1
RANSPTRREL

SEQ ID NO: 970 - protein, 10 aa, HIV-1
SPTRRELQVW

SEQ ID NO: 971 - protein, 10 aa, HIV-1
NSPSEAGADR

SEQ ID NO: 972 - protein, 10 aa, HIV-1
EAGADRQGTV

SEQ ID NO: 973 - protein, 10 aa, HIV-1
GTVSFNFPQV

SEQ ID NO: 974 - protein, 10 aa, HIV-1
VSFNFPQVTL

SEQ ID NO: 975 - protein, 10 aa, HIV-1
NFPQVTLWQR

SEQ ID NO: 976 - protein, 10 aa, HIV-1
QVTLWQRPLV

SEQ ID NO: 977 - protein, 10 aa, HIV-1
TLWQRPLVTI

SEQ ID NO: 978 - protein, 10 aa, HIV-1
WQRPLVTIKI

SEQ ID NO: 979 - protein, 10 aa, HIV-1
VTIKIGGQLK

SEQ ID NO: 980 - protein, 10 aa, HIV-1
KIGGQLKEAL

SEQ ID NO: 981 - protein, 10 aa, HIV-1
ALLDTGADDT

SEQ ID NO: 982 - protein, 10 aa, HIV-1
LLDTGADDTV

SEQ ID NO: 983 - protein, 10 aa, HIV-1
GADDTVLEEM

SEQ ID NO: 984 - protein, 10 aa, HIV-1
MSLPGRWKPK

SEQ ID NO: 985 - protein, 10 aa, HIV-1
SLPGRWKPKM

SEQ ID NO: 986 - protein, 10 aa, HIV-1
LPGRWKPKMI

SEQ ID NO: 987 - protein, 10 aa, HIV-1
RWKPKMIGGI

SEQ ID NO: 988 - protein, 10 aa, HIV-1
KMIGGIGGFI

SEQ ID NO: 989 - protein, 10 aa, HIV-1
MIGGIGGFIK

SEQ ID NO: 990 - protein, 10 aa, HIV-1
FIKVRQYDQI

SEQ ID NO: 991 - protein, 10 aa, HIV-1
KVRQYDQILI

SEQ ID NO: 992 - protein, 10 aa, HIV-1
RQYDQILIEI

SEQ ID NO: 993 - protein, 10 aa, HIV-1
QILIEICGHK

SEQ ID NO: 994 - protein, 10 aa, HIV-1
ILIEICGHKA

SEQ ID NO: 995 - protein, 10 aa, HIV-1
GTVLVGPTPV

SEQ ID NO: 996 - protein, 10 aa, HIV-1
VLVGPTPVNI

SEQ ID NO: 997 - protein, 10 aa, HIV-1
LVGPTPVNII

SEQ ID NO: 998 - protein, 10 aa, HIV-1
TPVNIIGRNL

SEQ ID NO: 999 - protein, 10 aa, HIV-1
IIGRNLLTQI

SEQ ID NO: 1000 - protein, 10 aa, HIV-1
NLLTQIGCTL

SEQ ID NO: 1001 - protein, 10 aa, HIV-1
TQIGCTLNFP

SEQ ID NO: 1002 - protein, 10 aa, HIV-1
QIGCTLNFPI

SEQ ID NO: 1003 - protein, 10 aa, HIV-1
CTLNFPISPI

SEQ ID NO: 1004 - protein, 10 aa, HIV-1
FPISPIETVP

SEQ ID NO: 1005 - protein, 10 aa, HIV-1
PISPIETVPV

SEQ ID NO: 1006 - protein, 10 aa, HIV-1
ISPIETVPVK

SEQ ID NO: 1007 - protein, 10 aa, HIV-1
SPIETVPVKL

SEQ ID NO: 1008 - protein, 10 aa, HIV-1
TVPVKLKPGM

SEQ ID NO: 1009 - protein, 10 aa, HIV-1
KLKPGMDGPK

SEQ ID NO: 1010 - protein, 10 aa, HIV-1
KQWPLTEEKI

SEQ ID NO: 1011 - protein, 10 aa, HIV-1
WPLTEEKIKA

SEQ ID NO: 1012 - protein, 10 aa, HIV-1
PLTEEKIKAL

SEQ ID NO: 1013 - protein, 10 aa, HIV-1
LTEEKIKALV

SEQ ID NO: 1014 - protein, 10 aa, HIV-1
EEKIKALVEI

SEQ ID NO: 1015 - protein, 10 aa, HIV-1
KALVEICTEM

SEQ ID NO: 1016 - protein, 10 aa, HIV-1
LVEICTEMEK

SEQ ID NO: 1017 - protein, 10 aa, HIV-1
MEKEGKISKI

SEQ ID NO: 1018 - protein, 10 aa, HIV-1
ISKIGPENPY

SEQ ID NO: 1019 - protein, 10 aa, HIV-1
GPENPYNTPV

SEQ ID NO: 1020 - protein, 10 aa, HIV-1
PENPYNTPVF

SEQ ID NO: 1021 - protein, 10 aa, HIV-1
NPYNTPVFAI

SEQ ID NO: 1022 - protein, 10 aa, HIV-1
PYNTPVFAIK

SEQ ID NO: 1023 - protein, 10 aa, HIV-1
YNTPVFAIKK

SEQ ID NO: 1024 - protein, 10 aa, HIV-1
NTPVFAIKKK

SEQ ID NO: 1025 - protein, 10 aa, HIV-1
FAIKKKDSTK

SEQ ID NO: 1026 - protein, 10 aa, HIV-1
KKKDSTKWRK

SEQ ID NO: 1027 - protein, 10 aa, HIV-1
STKWRKLVDF

SEQ ID NO: 1028 - protein, 10 aa, HIV-1
KLVDFRELNK

SEQ ID NO: 1029 - protein, 10 aa, HIV-1
LVDFRELNKR

SEQ ID NO: 1030 - protein, 10 aa, HIV-1
RELNKRTQDF

SEQ ID NO: 1031 - protein, 10 aa, HIV-1
RTQDFWEVQL

SEQ ID NO: 1032 - protein, 10 aa, HIV-1
WEVQLGIPHP

SEQ ID NO: 1033 - protein, 10 aa, HIV-1
EVQLGIPHPA

SEQ ID NO: 1034 - protein, 10 aa, HIV-1
QLGIPHPAGL

SEQ ID NO: 1035 - protein, 10 aa, HIV-1
GIPHPAGLKK

SEQ ID NO: 1036 - protein, 10 aa, HIV-1
IPHPAGLKKK

SEQ ID NO: 1037 - protein, 10 aa, HIV-1
GLKKKKSVTV

SEQ ID NO: 1038 - protein, 10 aa, HIV-1
VTVLDVGDAY

SEQ ID NO: 1039 - protein, 10 aa, HIV-1
TVLDVGDAYF

SEQ ID NO: 1040 - protein, 10 aa, HIV-1
VLDVGDAYFS

SEQ ID NO: 1041 - protein, 10 aa, HIV-1
YFSVPLDEDF

SEQ ID NO: 1042 - protein, 10 aa, HIV-1
FSVPLDEDFR

SEQ ID NO: 1043 - protein, 10 aa, HIV-1
SVPLDEDFRK

SEQ ID NO: 1044 - protein, 10 aa, HIV-1
VPLDEDFRKY

SEQ ID NO: 1045 - protein, 10 aa, HIV-1
PLDEDFRKYT

SEQ ID NO: 1046 - protein, 10 aa, HIV-1
DFRKYTAFTI

SEQ ID NO: 1047 - protein, 10 aa, HIV-1
KYTAFTIPSI

SEQ ID NO: 1048 - protein, 10 aa, HIV-1
FTIPSINNET

SEQ ID NO: 1049 - protein, 10 aa, HIV-1
SINNETPGIR

SEQ ID NO: 1050 - protein, 10 aa, HIV-1
NETPGIRYQY

SEQ ID NO: 1051 - protein, 10 aa, HIV-1
YQYNVLPQGW

SEQ ID NO: 1052 - protein, 10 aa, HIV-1
QYNVLPQGWK

SEQ ID NO: 1053 - protein, 10 aa, HIV-1
LPQGWKGSPA

SEQ ID NO: 1054 - protein, 10 aa, HIV-1
SPAIFQSSMT

SEQ ID NO: 1055 - protein, 10 aa, HIV-1
PAIFQSSMTK

SEQ ID NO: 1056 - protein, 10 aa, HIV-1
AIFQSSMTKI

SEQ ID NO: 1057 - protein, 10 aa, HIV-1
IFQSSMTKIL

SEQ ID NO: 1058 - protein, 10 aa, HIV-1
SSMTKILEPF

SEQ ID NO: 1059 - protein, 10 aa, HIV-1
SMTKILEPFR

SEQ ID NO: 1060 - protein, 10 aa, HIV-1
MTKILEPFRK

SEQ ID NO: 1061 - protein, 10 aa, HIV-1
KQNPDIVIYQ

SEQ ID NO: 1062 - protein, 10 aa, HIV-1
NPDIVIYQYM

SEQ ID NO: 1063 - protein, 10 aa, HIV-1
IVIYQYMDDL

SEQ ID NO: 1064 - protein, 10 aa, HIV-1
VIYQYMDDLY

SEQ ID NO: 1065 - protein, 10 aa, HIV-1
IYQYMDDLYV

SEQ ID NO: 1066 - protein, 10 aa, HIV-1
YMDDLYVGSD

SEQ ID NO: 1067 - protein, 10 aa, HIV-1
DLYVGSDLEI

SEQ ID NO: 1068 - protein, 10 aa, HIV-1
LEIGQHRTKI

SEQ ID NO: 1069 - protein, 10 aa, HIV-1
KIEELRQHLL

SEQ ID NO: 1070 - protein, 10 aa, HIV-1
EELRQHLLRW

SEQ ID NO: 1071 - protein, 10 aa, HIV-1
RQHLLRWGLT

SEQ ID NO: 1072 - protein, 10 aa, HIV-1
HLLRWGLTTP

SEQ ID NO: 1073 - protein, 10 aa, HIV-1
LLRWGLTTPD

SEQ ID NO: 1074 - protein, 10 aa, HIV-1
LRWGLTTPDK

SEQ ID NO: 1075 - protein, 10 aa, HIV-1
RWGLTTPDKK

SEQ ID NO: 1076 - protein, 10 aa, HIV-1
LTTPDKKHQK

SEQ ID NO: 1077 - protein, 10 aa, HIV-1
KHQKEPPFLW

SEQ ID NO: 1078 - protein, 10 aa, HIV-1
HQKEPPFLWM

SEQ ID NO: 1079 - protein, 10 aa, HIV-1
KEPPFLWMGY

SEQ ID NO: 1080 - protein, 10 aa, HIV-1
FLWMGYELHP

SEQ ID NO: 1081 - protein, 10 aa, HIV-1
MGYELHPDKW

SEQ ID NO: 1082 - protein, 10 aa, HIV-1
YELHPDKWTV

SEQ ID NO: 1083 - protein, 10 aa, HIV-1
ELHPDKWTVQ

SEQ ID NO: 1084 - protein, 10 aa, HIV-1
HPDKWTVQPI

SEQ ID NO: 1085 - protein, 10 aa, HIV-1
TVQPIVLPEK

SEQ ID NO: 1086 - protein, 10 aa, HIV-1
VLPEKDSWTV

SEQ ID NO: 1087 - protein, 10 aa, HIV-1
DSWTVNDIQK

SEQ ID NO: 1088 - protein, 10 aa, HIV-1
SWTVNDIQKL

SEQ ID NO: 1089 - protein, 10 aa, HIV-1
WTVNDIQKLV

SEQ ID NO: 1090 - protein, 10 aa, HIV-1
KLVGKLNWAS

SEQ ID NO: 1091 - protein, 10 aa, HIV-1
NWASQIYPGI

SEQ ID NO: 1092 - protein, 10 aa, HIV-1
WASQIYPGIK

SEQ ID NO: 1093 - protein, 10 aa, HIV-1
QIYPGIKVRQ

SEQ ID NO: 1094 - protein, 10 aa, HIV-1
IYPGIKVRQL

SEQ ID NO: 1095 - protein, 10 aa, HIV-1
KVRQLCKLLR

SEQ ID NO: 1096 - protein, 10 aa, HIV-1
RQLCKLLRGT

SEQ ID NO: 1097 - protein, 10 aa, HIV-1
QLCKLLRGTK

SEQ ID NO: 1098 - protein, 10 aa, HIV-1
KLLRGTKALT

SEQ ID NO: 1099 - protein, 10 aa, HIV-1
ALTEVIPLTE

SEQ ID NO: 1100 - protein, 10 aa, HIV-1
EVIPLTEEAE

SEQ ID NO: 1101 - protein, 10 aa, HIV-1
VIPLTEEAEL

SEQ ID NO: 1102 - protein, 10 aa, HIV-1
PLTEEAELEL

SEQ ID NO: 1103 - protein, 10 aa, HIV-1
EAELELAENR

SEQ ID NO: 1104 - protein, 10 aa, HIV-1
LELAENREIL

SEQ ID NO: 1105 - protein, 10 aa, HIV-1
ELAENREILK

SEQ ID NO: 1106 - protein, 10 aa, HIV-1
EILKEPVHGV

SEQ ID NO: 1107 - protein, 10 aa, HIV-1
ILKEPVHGVY

SEQ ID NO: 1108 - protein, 10 aa, HIV-1
VYYDPSKDLI

SEQ ID NO: 1109 - protein, 10 aa, HIV-1
DPSKDLIAEI

SEQ ID NO: 1110 - protein, 10 aa, HIV-1
AEIQKQGQGQ

SEQ ID NO: 1111 - protein, 10 aa, HIV-1
KQGQGQWTYQ

SEQ ID NO: 1112 - protein, 10 aa, HIV-1
GQGQWTYQIY

SEQ ID NO: 1113 - protein, 10 aa, HIV-1
WTYQIYQEPF

SEQ ID NO: 1114 - protein, 10 aa, HIV-1
TYQIYQEPFK

SEQ ID NO: 1115 - protein, 10 aa, HIV-1
QIYQEPFKNL

SEQ ID NO: 1116 - protein, 10 aa, HIV-1
IYQEPFKNLK

SEQ ID NO: 1117 - protein, 10 aa, HIV-1
EPFKNLKTGK

SEQ ID NO: 1118 - protein, 10 aa, HIV-1
PFKNLKTGKY

SEQ ID NO: 1119 - protein, 10 aa, HIV-1
KNLKTGKYAR

SEQ ID NO: 1120 - protein, 10 aa, HIV-1
NLKTGKYARM

SEQ ID NO: 1121 - protein, 10 aa, HIV-1
LKTGKYARMR

SEQ ID NO: 1122 - protein, 10 aa, HIV-1
RMRGAHTNDV

SEQ ID NO: 1123 - protein, 10 aa, HIV-1
KQLTEAVQKI

SEQ ID NO: 1124 - protein, 10 aa, HIV-1
AVQKITTESI

SEQ ID NO: 1125 - protein, 10 aa, HIV-1
VQKITTESIV

SEQ ID NO: 1126 - protein, 10 aa, HIV-1
KITTESIVIW

SEQ ID NO: 1127 - protein, 10 aa, HIV-1
TTESIVIWGK

SEQ ID NO: 1128 - protein, 10 aa, HIV-1
SIVIWGKTPK

SEQ ID NO: 1129 - protein, 10 aa, HIV-1
IVIWGKTPKF

SEQ ID NO: 1130 - protein, 10 aa, HIV-1
VIWGKTPKFK

SEQ ID NO: 1131 - protein, 10 aa, HIV-1
IWGKTPKFKL

SEQ ID NO: 1132 - protein, 10 aa, HIV-1
LPIQKETWET

SEQ ID NO: 1133 - protein, 10 aa, HIV-1
ETWETWWTEY

SEQ ID NO: 1134 - protein, 10 aa, HIV-1
ETWWTEYWQA

SEQ ID NO: 1135 - protein, 10 aa, HIV-1
YWQATWIPEW

SEQ ID NO: 1136 - protein, 10 aa, HIV-1
WQATWIPEWE

SEQ ID NO: 1137 - protein, 10 aa, HIV-1
QATWIPEWEF

SEQ ID NO: 1138 - protein, 10 aa, HIV-1
ATWIPEWEFV

SEQ ID NO: 1139 - protein, 10 aa, HIV-1
WIPEWEFVNT

SEQ ID NO: 1140 - protein, 10 aa, HIV-1
WEFVNTPPLV

SEQ ID NO: 1141 - protein, 10 aa, HIV-1
EFVNTPPLVK

SEQ ID NO: 1142 - protein, 10 aa, HIV-1
FVNTPPLVKL

SEQ ID NO: 1143 - protein, 10 aa, HIV-1
NTPPLVKLWY

SEQ ID NO: 1144 - protein, 10 aa, HIV-1
LVKLWYQLEK

SEQ ID NO: 1145 - protein, 10 aa, HIV-1
QLEKEPIVGA

SEQ ID NO: 1146 - protein, 10 aa, HIV-1
EPIVGAETFY

SEQ ID NO: 1147 - protein, 10 aa, HIV-1
PIVGAETFYV

SEQ ID NO: 1148 - protein, 10 aa, HIV-1
AETFYVDGAA

SEQ ID NO: 1149 - protein, 10 aa, HIV-1
TFYVDGAANR

SEQ ID NO: 1150 - protein, 10 aa, HIV-1
YVDGAANRET

SEQ ID NO: 1151 - protein, 10 aa, HIV-1
AANRETKLGK

SEQ ID NO: 1152 - protein, 10 aa, HIV-1
RETKLGKAGY

SEQ ID NO: 1153 - protein, 10 aa, HIV-1
ETKLGKAGYV

SEQ ID NO: 1154 - protein, 10 aa, HIV-1
KAGYVTNRGR

SEQ ID NO: 1155 - protein, 10 aa, HIV-1
GYVTNRGRQK

SEQ ID NO: 1156 - protein, 10 aa, HIV-1
YVTNRGRQKV

SEQ ID NO: 1157 - protein, 10 aa, HIV-1
VTNRGRQKVV

SEQ ID NO: 1158 - protein, 10 aa, HIV-1
NRGRQKVVTL

SEQ ID NO: 1159 - protein, 10 aa, HIV-1
VTLTDTTNQK

SEQ ID NO: 1160 - protein, 10 aa, HIV-1
TLTDTTNQKT

SEQ ID NO: 1161 - protein, 10 aa, HIV-1
NQKTELQAIY

SEQ ID NO: 1162 - protein, 10 aa, HIV-1
TELQAIYLAL

SEQ ID NO: 1163 - protein, 10 aa, HIV-1
ELQAIYLALQ

SEQ ID NO: 1164 - protein, 10 aa, HIV-1
IYLALQDSGL

SEQ ID NO: 1165 - protein, 10 aa, HIV-1
LALQDSGLEV

SEQ ID NO: 1166 - protein, 10 aa, HIV-1
LQDSGLEVNI

SEQ ID NO: 1167 - protein, 10 aa, HIV-1
EVNIVTDSQY

SEQ ID NO: 1168 - protein, 10 aa, HIV-1
NIVTDSQYAL

SEQ ID NO: 1169 - protein, 10 aa, HIV-1
SQYALGIIQA

SEQ ID NO: 1170 - protein, 10 aa, HIV-1
AQPDQSESEL

SEQ ID NO: 1171 - protein, 10 aa, HIV-1
SESELVNQII

SEQ ID NO: 1172 - protein, 10 aa, HIV-1
ELVNQIIEQL

SEQ ID NO: 1173 - protein, 10 aa, HIV-1
LVNQIIEQLI

SEQ ID NO: 1174 - protein, 10 aa, HIV-1
NQIIEQLIKK

SEQ ID NO: 1175 - protein, 10 aa, HIV-1
QLIKKEKVYL

SEQ ID NO: 1176 - protein, 10 aa, HIV-1
LIKKEKVYLA

SEQ ID NO: 1177 - protein, 10 aa, HIV-1
EKVYLAWVPA

SEQ ID NO: 1178 - protein, 10 aa, HIV-1
KVYLAWVPAH

SEQ ID NO: 1179 - protein, 10 aa, HIV-1
VYLAWVPAHK

SEQ ID NO: 1180 - protein, 10 aa, HIV-1
YLAWVPAHKG

SEQ ID NO: 1181 - protein, 10 aa, HIV-1
LAWVPAHKGI

SEQ ID NO: 1182 - protein, 10 aa, HIV-1
QVDKLVSAGI

SEQ ID NO: 1183 - protein, 10 aa, HIV-1
KLVSAGIRKV

SEQ ID NO: 1184 - protein, 10 aa, HIV-1
VSAGIRKVLF

SEQ ID NO: 1185 - protein, 10 aa, HIV-1
KVLFLDGIDK

SEQ ID NO: 1186 - protein, 10 aa, HIV-1
VLFLDGIDKA

SEQ ID NO: 1187 - protein, 10 aa, HIV-1
FLDGIDKAQD

SEQ ID NO: 1188 - protein, 10 aa, HIV-1
DEHEKYHSNW

SEQ ID NO: 1189 - protein, 10 aa, HIV-1
WRAMASDFNL

SEQ ID NO: 1190 - protein, 10 aa, HIV-1
MASDFNLPPV

SEQ ID NO: 1191 - protein, 10 aa, HIV-1
NLPPVVAKEI

SEQ ID NO: 1192 - protein, 10 aa, HIV-1
LPPVVAKEIV

SEQ ID NO: 1193 - protein, 10 aa, HIV-1
PPVVAKEIVA

SEQ ID NO: 1194 - protein, 10 aa, HIV-1
IVASCDKCQL

SEQ ID NO: 1195 - protein, 10 aa, HIV-1
VASCDKCQLK

SEQ ID NO: 1196 - protein, 10 aa, HIV-1
GIWQLDCTHL

SEQ ID NO: 1197 - protein, 10 aa, HIV-1
THLEGKVILV

SEQ ID NO: 1198 - protein, 10 aa, HIV-1
HLEGKVILVA

SEQ ID NO: 1199 - protein, 10 aa, HIV-1
KVILVAVHVA

SEQ ID NO: 1200 - protein, 10 aa, HIV-1
LVAVHVASGY

SEQ ID NO: 1201 - protein, 10 aa, HIV-1
VASGYIEAEV

SEQ ID NO: 1202 - protein, 10 aa, HIV-1
AEVIPAETGQ

SEQ ID NO: 1203 - protein, 10 aa, HIV-1
IPAETGQETA

SEQ ID NO: 1204 - protein, 10 aa, HIV-1
PAETGQETAY

SEQ ID NO: 1205 - protein, 10 aa, HIV-1
AETGQETAYF

SEQ ID NO: 1206 - protein, 10 aa, HIV-1
ETGQETAYFL

SEQ ID NO: 1207 - protein, 10 aa, HIV-1
GQETAYFLLK

SEQ ID NO: 1208 - protein, 10 aa, HIV-1
QETAYFLLKL

SEQ ID NO: 1209 - protein, 10 aa, HIV-1
ETAYFLLKLA

SEQ ID NO: 1210 - protein, 10 aa, HIV-1
AYFLLKLAGR

SEQ ID NO: 1211 - protein, 10 aa, HIV-1
YFLLKLAGRW

SEQ ID NO: 1212 - protein, 10 aa, HIV-1
LLKLAGRWPV

SEQ ID NO: 1213 - protein, 10 aa, HIV-1
LKLAGRWPVK

SEQ ID NO: 1214 - protein, 10 aa, HIV-1
KLAGRWPVKT

SEQ ID NO: 1215 - protein, 10 aa, HIV-1
TIHTDNGSNF

SEQ ID NO: 1216 - protein, 10 aa, HIV-1
NGSNFTGATV

SEQ ID NO: 1217 - protein, 10 aa, HIV-1
GSNFTGATVR

SEQ ID NO: 1218 - protein, 10 aa, HIV-1
TGATVRAACW

SEQ ID NO: 1219 - protein, 10 aa, HIV-1
GATVRAACWW

SEQ ID NO: 1220 - protein, 10 aa, HIV-1
ATVRAACWWA

SEQ ID NO: 1221 - protein, 10 aa, HIV-1
RAACWWAGIK

SEQ ID NO: 1222 - protein, 10 aa, HIV-1
CWWAGIKQEF

SEQ ID NO: 1223 - protein, 10 aa, HIV-1
GIKQEFGIPY

SEQ ID NO: 1224 - protein, 10 aa, HIV-1
IPYNPQSQGV

SEQ ID NO: 1225 - protein, 10 aa, HIV-1
SQGVVESMNK

SEQ ID NO: 1226 - protein, 10 aa, HIV-1
GVVESMNKEL

SEQ ID NO: 1227 - protein, 10 aa, HIV-1
VVESMNKELK

SEQ ID NO: 1228 - protein, 10 aa, HIV-1
SMNKELKKII

SEQ ID NO: 1229 - protein, 10 aa, HIV-1
ELKKIIGQVR

SEQ ID NO: 1230 - protein, 10 aa, HIV-1
GQVRDQAEHL

SEQ ID NO: 1231 - protein, 10 aa, HIV-1
QVRDQAEHLK

SEQ ID NO: 1232 - protein, 10 aa, HIV-1
AEHLKTAVQM

SEQ ID NO: 1233 - protein, 10 aa, HIV-1
HLKTAVQMAV

SEQ ID NO: 1234 - protein, 10 aa, HIV-1
KTAVQMAVFI

SEQ ID NO: 1235 - protein, 10 aa, HIV-1
TAVQMAVFIH

SEQ ID NO: 1236 - protein, 10 aa, HIV-1
VQMAVFIHNF

SEQ ID NO: 1237 - protein, 10 aa, HIV-1
QMAVFIHNFK

SEQ ID NO: 1238 - protein, 10 aa, HIV-1
MAVFIHNFKR

SEQ ID NO: 1239 - protein, 10 aa, HIV-1
AVFIHNFKRK

SEQ ID NO: 1240 - protein, 10 aa, HIV-1
FKRKGGIGGY

SEQ ID NO: 1241 - protein, 10 aa, HIV-1
RIVDIIATDI

SEQ ID NO: 1242 - protein, 10 aa, HIV-1
DIIATDIQTK

SEQ ID NO: 1243 - protein, 10 aa, HIV-1
KQITKIQNFR

SEQ ID NO: 1244 - protein, 10 aa, HIV-1
QITKIQNFRV

SEQ ID NO: 1245 - protein, 10 aa, HIV-1
ITKIQNFRVY

SEQ ID NO: 1246 - protein, 10 aa, HIV-1
KIQNFRVYYR

SEQ ID NO: 1247 - protein, 10 aa, HIV-1
NFRVYYRDSR

SEQ ID NO: 1248 - protein, 10 aa, HIV-1
VYYRDSRNPL

SEQ ID NO: 1249 - protein, 10 aa, HIV-1
YYRDSRNPLW

SEQ ID NO: 1250 - protein, 10 aa, HIV-1
RNPLWKGPAK

SEQ ID NO: 1251 - protein, 10 aa, HIV-1
NPLWKGPAKL

SEQ ID NO: 1252 - protein, 10 aa, HIV-1
PLWKGPAKLL

SEQ ID NO: 1253 - protein, 10 aa, HIV-1
KLLWKGEGAV

SEQ ID NO: 1254 - protein, 10 aa, HIV-1
LLWKGEGAVV

SEQ ID NO: 1255 - protein, 10 aa, HIV-1
VVIQDNSDIK

SEQ ID NO: 1256 - protein, 10 aa, HIV-1
VIQDNSDIKV

SEQ ID NO: 1257 - protein, 10 aa, HIV-1
IQDNSDIKVV

SEQ ID NO: 1258 - protein, 10 aa, HIV-1
DNSDIKVVPR

SEQ ID NO: 1259 - protein, 10 aa, HIV-1
NSDIKVVPRR

SEQ ID NO: 1260 - protein, 10 aa, HIV-1
RRKAKIIRDY

SEQ ID NO: 1261 - protein, 10 aa, HIV-1
KAKIIRDYGK

SEQ ID NO: 1262 - protein, 10 aa, HIV-1
KIIRDYGKQM

SEQ ID NO: 1263 - protein, 10 aa, HIV-1
IIRDYGKQMA

SEQ ID NO: 1264 - protein, 10 aa, HIV-1
KQMAGDDCVA

SEQ ID NO: 1265 - protein, 10 aa, HIV-1
MAGDDCVASR

SEQ ID NO: 1266 - protein, 11 aa, HIV-1
VLSGGELDRWE

SEQ ID NO: 1267 - protein, 11 aa, HIV-1
LSGGELDRWEK

SEQ ID NO: 1268 - protein, 11 aa, HIV-1
GELDRWEKIRL

SEQ ID NO: 1269 - protein, 11 aa, HIV-1
ELDRWEKIRLR

SEQ ID NO: 1270 - protein, 11 aa, HIV-1
KIRLRPGGKKK

SEQ ID NO: 1271 - protein, 11 aa, HIV-1
RLRPGGKKKYK

SEQ ID NO: 1272 - protein, 11 aa, HIV-1
HIVWASRELER

SEQ ID NO: 1273 - protein, 11 aa, HIV-1
WASRELERFAV

SEQ ID NO: 1274 - protein, 11 aa, HIV-1
ELERFAVNPGL

SEQ ID NO: 1275 - protein, 11 aa, HIV-1
LERFAVNPGLL

SEQ ID NO: 1276 - protein, 11 aa, HIV-1
GLLETSEGCRQ

SEQ ID NO: 1277 - protein, 11 aa, HIV-1
LLETSEGCRQI

SEQ ID NO: 1278 - protein, 11 aa, HIV-1
LETSEGCRQIL

SEQ ID NO: 1279 - protein, 11 aa, HIV-1
SEGCRQILGQL

SEQ ID NO: 1280 - protein, 11 aa, HIV-1
RQILGQLQPSL

SEQ ID NO: 1281 - protein, 11 aa, HIV-1
ILGQLQPSLQT

SEQ ID NO: 1282 - protein, 11 aa, HIV-1
QPSLQTGSEEL

SEQ ID NO: 1283 - protein, 11 aa, HIV-1
LQTGSEELRSL

SEQ ID NO: 1284 - protein, 11 aa, HIV-1
QTGSEELRSLY

SEQ ID NO: 1285 - protein, 11 aa, HIV-1
SEELRSLYNTV

SEQ ID NO: 1286 - protein, 11 aa, HIV-1
RSLYNTVATLY

SEQ ID NO: 1287 - protein, 11 aa, HIV-1
SLYNTVATLYC

SEQ ID NO: 1288 - protein, 11 aa, HIV-1
LYNTVATLYCV

SEQ ID NO: 1289 - protein, 11 aa, HIV-1
NTVATLYCVHQ

SEQ ID NO: 1290 - protein, 11 aa, HIV-1
TVATLYCVHQR

SEQ ID NO: 1291 - protein, 11 aa, HIV-1
TLYCVHQRIEI

SEQ ID NO: 1292 - protein, 11 aa, HIV-1
LYCVHQRIEIK

SEQ ID NO: 1293 - protein, 11 aa, HIV-1
EIKDTKEALDK

SEQ ID NO: 1294 - protein, 11 aa, HIV-1
ALDKIEEEQNK

SEQ ID NO: 1295 - protein, 11 aa, HIV-1
AAADTGHSNQV

SEQ ID NO: 1296 - protein, 11 aa, HIV-1
HSNQVSQNYPI

SEQ ID NO: 1297 - protein, 11 aa, HIV-1
YPIVQNIQGQM

SEQ ID NO: 1298 - protein, 11 aa, HIV-1
PIVQNIQGQMV

SEQ ID NO: 1299 - protein, 11 aa, HIV-1
NIQGQMVHQAI

SEQ ID NO: 1300 - protein, 11 aa, HIV-1
GQMVHQAISPR

SEQ ID NO: 1301 - protein, 11 aa, HIV-1
MVHQAISPRTL

SEQ ID NO: 1302 - protein, 11 aa, HIV-1
QAISPRTLNAW

SEQ ID NO: 1303 - protein, 11 aa, HIV-1
AISPRTLNAWV

SEQ ID NO: 1304 - protein, 11 aa, HIV-1
ISPRTLNAWVK

SEQ ID NO: 1305 - protein, 11 aa, HIV-1
SPRTLNAWVKV

SEQ ID NO: 1306 - protein, 11 aa, HIV-1
LNAWVKVVEEK

SEQ ID NO: 1307 - protein, 11 aa, HIV-1
AWVKVVEEKAF

SEQ ID NO: 1308 - protein, 11 aa, HIV-1
VVEEKAFSPEV

SEQ ID NO: 1309 - protein, 11 aa, HIV-1
KAFSPEVIPMF

SEQ ID NO: 1310 - protein, 11 aa, HIV-1
FSPEVIPMFSA

SEQ ID NO: 1311 - protein, 11 aa, HIV-1
SPEVIPMFSAL

SEQ ID NO: 1312 - protein, 11 aa, HIV-1
EVIPMFSALSE

SEQ ID NO: 1313 - protein, 11 aa, HIV-1
IPMFSALSEGA

SEQ ID NO: 1314 - protein, 11 aa, HIV-1
ALSEGATPQDL

SEQ ID NO: 1315 - protein, 11 aa, HIV-1
EGATPQDLNTM

SEQ ID NO: 1316 - protein, 11 aa, HIV-1
PQDLNTMLNTV

SEQ ID NO: 1317 - protein, 11 aa, HIV-1
TMLNTVGGHQA

SEQ ID NO: 1318 - protein, 11 aa, HIV-1
MLNTVGGHQAA

SEQ ID NO: 1319 - protein, 11 aa, HIV-1
TVGGHQAAMQM

SEQ ID NO: 1320 - protein, 11 aa, HIV-1
GGHQAAMQMLK

SEQ ID NO: 1321 - protein, 11 aa, HIV-1
QAAMQMLKETI

SEQ ID NO: 1322 - protein, 11 aa, HIV-1
MQMLKETINEE

SEQ ID NO: 1323 - protein, 11 aa, HIV-1
QMLKETINEEA

SEQ ID NO: 1324 - protein, 11 aa, HIV-1
MLKETINEEAA

SEQ ID NO: 1325 - protein, 11 aa, HIV-1
TINEEAAEWDR

SEQ ID NO: 1326 - protein, 11 aa, HIV-1
EAAEWDRVHPV

SEQ ID NO: 1327 - protein, 11 aa, HIV-1
RVHPVHAGPIA

SEQ ID NO: 1328 - protein, 11 aa, HIV-1
HPVHAGPIAPG

SEQ ID NO: 1329 - protein, 11 aa, HIV-1
HAGPIAPGQMR

SEQ ID NO: 1330 - protein, 11 aa, HIV-1
TTSTLQEQIGW

SEQ ID NO: 1331 - protein, 11 aa, HIV-1
QIGWMTNNPPI

SEQ ID NO: 1332 - protein, 11 aa, HIV-1
IPVGEIYKRWI

SEQ ID NO: 1333 - protein, 11 aa, HIV-1
EIYKRWIILGL

SEQ ID NO: 1334 - protein, 11 aa, HIV-1
KRWIILGLNKI

SEQ ID NO: 1335 - protein, 11 aa, HIV-1
WIILGLNKIVR

SEQ ID NO: 1336 - protein, 11 aa, HIV-1
IILGLNKIVRM

SEQ ID NO: 1337 - protein, 11 aa, HIV-1
KIVRMYSPTSI

SEQ ID NO: 1338 - protein, 11 aa, HIV-1
IVRMYSPTSIL

SEQ ID NO: 1339 - protein, 11 aa, HIV-1
RMYSPTSILDI

SEQ ID NO: 1340 - protein, 11 aa, HIV-1
MYSPTSILDIR

SEQ ID NO: 1341 - protein, 11 aa, HIV-1
TSILDIRQGPK

SEQ ID NO: 1342 - protein, 11 aa, HIV-1
DIRQGPKEPFR

SEQ ID NO: 1343 - protein, 11 aa, HIV-1
RQGPKEPFRDY

SEQ ID NO: 1344 - protein, 11 aa, HIV-1
QGPKEPFRDYV

SEQ ID NO: 1345 - protein, 11 aa, HIV-1
EPFRDYVDRFY

SEQ ID NO: 1346 - protein, 11 aa, HIV-1
PFRDYVDRFYK

SEQ ID NO: 1347 - protein, 11 aa, HIV-1
DYVDRFYKTLR

SEQ ID NO: 1348 - protein, 11 aa, HIV-1
YVDRFYKTLRA

SEQ ID NO: 1349 - protein, 11 aa, HIV-1
TLRAEQASQEV

SEQ ID NO: 1350 - protein, 11 aa, HIV-1
AEQASQEVKNW

SEQ ID NO: 1351 - protein, 11 aa, HIV-1
QEVKNWMTETL

SEQ ID NO: 1352 - protein, 11 aa, HIV-1
EVKNWMTETLL

SEQ ID NO: 1353 - protein, 11 aa, HIV-1
WMTETLLVQNA

SEQ ID NO: 1354 - protein, 11 aa, HIV-1
LLVQNANPDCK

SEQ ID NO: 1355 - protein, 11 aa, HIV-1
NANPDCKTILK

SEQ ID NO: 1356 - protein, 11 aa, HIV-1
NPDCKTILKAL

SEQ ID NO: 1357 - protein, 11 aa, HIV-1
KTILKALGPAA

SEQ ID NO: 1358 - protein, 11 aa, HIV-1
ILKALGPAATL

SEQ ID NO: 1359 - protein, 11 aa, HIV-1
ALGPAATLEEM

SEQ ID NO: 1360 - protein, 11 aa, HIV-1
EEMMTACQGVG

SEQ ID NO: 1361 - protein, 11 aa, HIV-1
MTACQGVGGPG

SEQ ID NO: 1362 - protein, 11 aa, HIV-1
ACQGVGGPGHK

SEQ ID NO: 1363 - protein, 11 aa, HIV-1
GVGGPGHKARV

SEQ ID NO: 1364 - protein, 11 aa, HIV-1
KARVLAEAMSQ

SEQ ID NO: 1365 - protein, 11 aa, HIV-1
AEAMSQVTNSA

SEQ ID NO: 1366 - protein, 11 aa, HIV-1
EAMSQVTNSAT

SEQ ID NO: 1367 - protein, 11 aa, HIV-1
AMSQVTNSATI

SEQ ID NO: 1368 - protein, 11 aa, HIV-1
MSQVTNSATIM

SEQ ID NO: 1369 - protein, 11 aa, HIV-1
SQVTNSATIMM

SEQ ID NO: 1370 - protein, 11 aa, HIV-1
VTNSATIMMQR

SEQ ID NO: 1371 - protein, 11 aa, HIV-1
ATIMMQRGNFR

SEQ ID NO: 1372 - protein, 11 aa, HIV-1
MMQRGNFRNQR

SEQ ID NO: 1373 - protein, 11 aa, HIV-1
MQRGNFRNQRK

SEQ ID NO: 1374 - protein, 11 aa, HIV-1
FRNQRKIVKCF

SEQ ID NO: 1375 - protein, 11 aa, HIV-1
HTARNCRAPRK

SEQ ID NO: 1376 - protein, 11 aa, HIV-1
TARNCRAPRKK

SEQ ID NO: 1377 - protein, 11 aa, HIV-1
EGHQMKDCTER

SEQ ID NO: 1378 - protein, 11 aa, HIV-1
DCTERQANFLR

SEQ ID NO: 1379 - protein, 11 aa, HIV-1
RQANFLREDLA

SEQ ID NO: 1380 - protein, 11 aa, HIV-1
QANFLREDLAF

SEQ ID NO: 1381 - protein, 11 aa, HIV-1
LAFLQGKAREF

SEQ ID NO: 1382 - protein, 11 aa, HIV-1
FLQGKAREFSS

SEQ ID NO: 1383 - protein, 11 aa, HIV-1
KAREFSSEQTR

SEQ ID NO: 1384 - protein, 11 aa, HIV-1
EQTRANSPTRR

SEQ ID NO: 1385 - protein, 11 aa, HIV-1
TRANSPTRREL

SEQ ID NO: 1386 - protein, 11 aa, HIV-1
NSPTRRELQVW

SEQ ID NO: 1387 - protein, 11 aa, HIV-1
LQVWGRDNNSP

SEQ ID NO: 1388 - protein, 11 aa, HIV-1
QGTVSFNFPQV

SEQ ID NO: 1389 - protein, 11 aa, HIV-1
TVSFNFPQVTL

SEQ ID NO: 1390 - protein, 11 aa, HIV-1
VSFNFPQVTLW

SEQ ID NO: 1391 - protein, 11 aa, HIV-1
FNFPQVTLWQR

SEQ ID NO: 1392 - protein, 11 aa, HIV-1
FPQVTLWQRPL

SEQ ID NO: 1393 - protein, 11 aa, HIV-1
VTLWQRPLVTI

SEQ ID NO: 1394 - protein, 11 aa, HIV-1
TLWQRPLVTIK

SEQ ID NO: 1395 - protein, 11 aa, HIV-1
LWQRPLVTIKI

SEQ ID NO: 1396 - protein, 11 aa, HIV-1
PLVTIKIGGQL

SEQ ID NO: 1397 - protein, 11 aa, HIV-1
LVTIKIGGQLK

SEQ ID NO: 1398 - protein, 11 aa, HIV-1
KIGGQLKEALL

SEQ ID NO: 1399 - protein, 11 aa, HIV-1
QLKEALLDTGA

SEQ ID NO: 1400 - protein, 11 aa, HIV-1
ALLDTGADDTV

SEQ ID NO: 1401 - protein, 11 aa, HIV-1
LLDTGADDTVL

SEQ ID NO: 1402 - protein, 11 aa, HIV-1
TGADDTVLEEM

SEQ ID NO: 1403 - protein, 11 aa, HIV-1
TVLEEMSLPGR

SEQ ID NO: 1404 - protein, 11 aa, HIV-1
SLPGRWKPKMI

SEQ ID NO: 1405 - protein, 11 aa, HIV-1
GRWKPKMIGGI

SEQ ID NO: 1406 - protein, 11 aa, HIV-1
KPKMIGGIGGF

SEQ ID NO: 1407 - protein, 11 aa, HIV-1
KMIGGIGGFIK

SEQ ID NO: 1408 - protein, 11 aa, HIV-1
MIGGIGGFIKV

SEQ ID NO: 1409 - protein, 11 aa, HIV-1
GFIKVRQYDQI

SEQ ID NO: 1410 - protein, 11 aa, HIV-1
FIKVRQYDQIL

SEQ ID NO: 1411 - protein, 11 aa, HIV-1
RQYDQILIEIC

SEQ ID NO: 1412 - protein, 11 aa, HIV-1
DQILIEICGHK

SEQ ID NO: 1413 - protein, 11 aa, HIV-1
ILIEICGHKAI

SEQ ID NO: 1414 - protein, 11 aa, HIV-1
EICGHKAIGTV

SEQ ID NO: 1415 - protein, 11 aa, HIV-1
TVLVGPTPVNI

SEQ ID NO: 1416 - protein, 11 aa, HIV-1
VLVGPTPVNII

SEQ ID NO: 1417 - protein, 11 aa, HIV-1
TPVNIIGRNLL

SEQ ID NO: 1418 - protein, 11 aa, HIV-1
NIIGRNLLTQI

SEQ ID NO: 1419 - protein, 11 aa, HIV-1
LLTQIGCTLNF

SEQ ID NO: 1420 - protein, 11 aa, HIV-1
TQIGCTLNFPI

SEQ ID NO: 1421 - protein, 11 aa, HIV-1
TLNFPISPIET

SEQ ID NO: 1422 - protein, 11 aa, HIV-1
LNFPISPIETV

SEQ ID NO: 1423 - protein, 11 aa, HIV-1
FPISPIETVPV

SEQ ID NO: 1424 - protein, 11 aa, HIV-1
ETVPVKLKPGM

SEQ ID NO: 1425 - protein, 11 aa, HIV-1
KLKPGMDGPKV

SEQ ID NO: 1426 - protein, 11 aa, HIV-1
GMDGPKVKQWP

SEQ ID NO: 1427 - protein, 11 aa, HIV-1
KVKQWPLTEEK

SEQ ID NO: 1428 - protein, 11 aa, HIV-1
KQWPLTEEKIK

SEQ ID NO: 1429 - protein, 11 aa, HIV-1
WPLTEEKIKAL

SEQ ID NO: 1430 - protein, 11 aa, HIV-1
PLTEEKIKALV

SEQ ID NO: 1431 - protein, 11 aa, HIV-1
ALVEICTEMEK

SEQ ID NO: 1432 - protein, 11 aa, HIV-1
EICTEMEKEGK

SEQ ID NO: 1433 - protein, 11 aa, HIV-1
KISKIGPENPY

SEQ ID NO: 1434 - protein, 11 aa, HIV-1
GPENPYNTPVF

SEQ ID NO: 1435 - protein, 11 aa, HIV-1
ENPYNTPVFAI

SEQ ID NO: 1436 - protein, 11 aa, HIV-1
NPYNTPVFAIK

SEQ ID NO: 1437 - protein, 11 aa, HIV-1
PYNTPVFAIKK

SEQ ID NO: 1438 - protein, 11 aa, HIV-1
FAIKKKDSTKW

SEQ ID NO: 1439 - protein, 11 aa, HIV-1
AIKKKDSTKWR

SEQ ID NO: 1440 - protein, 11 aa, HIV-1
KKDSTKWRKLV

SEQ ID NO: 1441 - protein, 11 aa, HIV-1
STKWRKLVDFR

SEQ ID NO: 1442 - protein, 11 aa, HIV-1
KLVDFRELNKR

SEQ ID NO: 1443 - protein, 11 aa, HIV-1
TQDFWEVQLGI

SEQ ID NO: 1444 - protein, 11 aa, HIV-1
WEVQLGIPHPA

SEQ ID NO: 1445 - protein, 11 aa, HIV-1
VQLGIPHPAGL

SEQ ID NO: 1446 - protein, 11 aa, HIV-1
QLGIPHPAGLK

SEQ ID NO: 1447 - protein, 11 aa, HIV-1
LGIPHPAGLKK

SEQ ID NO: 1448 - protein, 11 aa, HIV-1
GIPHPAGLKKK

SEQ ID NO: 1449 - protein, 11 aa, HIV-1
IPHPAGLKKKK

SEQ ID NO: 1450 - protein, 11 aa, HIV-1
HPAGLKKKKSV

SEQ ID NO: 1451 - protein, 11 aa, HIV-1
GLKKKKSVTVL

SEQ ID NO: 1452 - protein, 11 aa, HIV-1
SVTVLDVGDAY

SEQ ID NO: 1453 - protein, 11 aa, HIV-1
VTVLDVGDAYF

SEQ ID NO: 1454 - protein, 11 aa, HIV-1
VLDVGDAYFSV

SEQ ID NO: 1455 - protein, 11 aa, HIV-1
DVGDAYFSVPL

SEQ ID NO: 1456 - protein, 11 aa, HIV-1
AYFSVPLDEDF

SEQ ID NO: 1457 - protein, 11 aa, HIV-1
YFSVPLDEDFR

SEQ ID NO: 1458 - protein, 11 aa, HIV-1
FSVPLDEDFRK

SEQ ID NO: 1459 - protein, 11 aa, HIV-1
SVPLDEDFRKY

SEQ ID NO: 1460 - protein, 11 aa, HIV-1
PLDEDFRKYTA

SEQ ID NO: 1461 - protein, 11 aa, HIV-1
RKYTAFTIPSI

SEQ ID NO: 1462 - protein, 11 aa, HIV-1
IPSINNETPGI

SEQ ID NO: 1463 - protein, 11 aa, HIV-1
SINNETPGIRY

SEQ ID NO: 1464 - protein, 11 aa, HIV-1
ETPGIRYQYNV

SEQ ID NO: 1465 - protein, 11 aa, HIV-1
TPGIRYQYNVL

SEQ ID NO: 1466 - protein, 11 aa, HIV-1
RYQYNVLPQGW

SEQ ID NO: 1467 - protein, 11 aa, HIV-1
YQYNVLPQGWK

SEQ ID NO: 1468 - protein, 11 aa, HIV-1
VLPQGWKGSPA

SEQ ID NO: 1469 - protein, 11 aa, HIV-1
LPQGWKGSPAI

SEQ ID NO: 1470 - protein, 11 aa, HIV-1
KGSPAIFQSSM

SEQ ID NO: 1471 - protein, 11 aa, HIV-1
SPAIFQSSMTK

SEQ ID NO: 1472 - protein, 11 aa, HIV-1
AIFQSSMTKIL

SEQ ID NO: 1473 - protein, 11 aa, HIV-1
QSSMTKILEPF

SEQ ID NO: 1474 - protein, 11 aa, HIV-1
SSMTKILEPFR

SEQ ID NO: 1475 - protein, 11 aa, HIV-1
SMTKILEPFRK

SEQ ID NO: 1476 - protein, 11 aa, HIV-1
EPFRKQNPDIV

SEQ ID NO: 1477 - protein, 11 aa, HIV-1
KQNPDIVIYQY

SEQ ID NO: 1478 - protein, 11 aa, HIV-1
DIVIYQYMDDL

SEQ ID NO: 1479 - protein, 11 aa, HIV-1
IVIYQYMDDLY

SEQ ID NO: 1480 - protein, 11 aa, HIV-1
VIYQYMDDLYV

SEQ ID NO: 1481 - protein, 11 aa, HIV-1
YQYMDDLYVGS

SEQ ID NO: 1482 - protein, 11 aa, HIV-1
YMDDLYVGSDL

SEQ ID NO: 1483 - protein, 11 aa, HIV-1
DLEIGQHRTKI

SEQ ID NO: 1484 - protein, 11 aa, HIV-1
GQHRTKIEELR

SEQ ID NO: 1485 - protein, 11 aa, HIV-1
KIEELRQHLLR

SEQ ID NO: 1486 - protein, 11 aa, HIV-1
ELRQHLLRWGL

SEQ ID NO: 1487 - protein, 11 aa, HIV-1
RQHLLRWGLTT

SEQ ID NO: 1488 - protein, 11 aa, HIV-1
LLRWGLTTPDK

SEQ ID NO: 1489 - protein, 11 aa, HIV-1
LRWGLTTPDKK

SEQ ID NO: 1490 - protein, 11 aa, HIV-1
KKHQKEPPFLW

SEQ ID NO: 1491 - protein, 11 aa, HIV-1
EPPFLWMGYEL

SEQ ID NO: 1492 - protein, 11 aa, HIV-1
FLWMGYELHPD

SEQ ID NO: 1493 - protein, 11 aa, HIV-1
LWMGYELHPDK

SEQ ID NO: 1494 - protein, 11 aa, HIV-1
ELHPDKWTVQP

SEQ ID NO: 1495 - protein, 11 aa, HIV-1
HPDKWTVQPIV

SEQ ID NO: 1496 - protein, 11 aa, HIV-1
WTVQPIVLPEK

SEQ ID NO: 1497 - protein, 11 aa, HIV-1
QPIVLPEKDSW

SEQ ID NO: 1498 - protein, 11 aa, HIV-1
IVLPEKDSWTV

SEQ ID NO: 1499 - protein, 11 aa, HIV-1
TVNDIQKLVGK

SEQ ID NO: 1500 - protein, 11 aa, HIV-1
IQKLVGKLNWA

SEQ ID NO: 1501 - protein, 11 aa, HIV-1
KLVGKLNWASQ

SEQ ID NO: 1502 - protein, 11 aa, HIV-1
LVGKLNWASQI

SEQ ID NO: 1503 - protein, 11 aa, HIV-1
KLNWASQIYPG

SEQ ID NO: 1504 - protein, 11 aa, HIV-1
WASQIYPGIKV

SEQ ID NO: 1505 - protein, 11 aa, HIV-1
ASQIYPGIKVR

SEQ ID NO: 1506 - protein, 11 aa, HIV-1
QIYPGIKVRQL

SEQ ID NO: 1507 - protein, 11 aa, HIV-1
RQLCKLLRGTK

SEQ ID NO: 1508 - protein, 11 aa, HIV-1
KLLRGTKALTE

SEQ ID NO: 1509 - protein, 11 aa, HIV-1
LLRGTKALTEV

SEQ ID NO: 1510 - protein, 11 aa, HIV-1
GTKALTEVIPL

SEQ ID NO: 1511 - protein, 11 aa, HIV-1
ALTEVIPLTEE

SEQ ID NO: 1512 - protein, 11 aa, HIV-1
EVIPLTEEAEL

SEQ ID NO: 1513 - protein, 11 aa, HIV-1
IPLTEEAELEL

SEQ ID NO: 1514 - protein, 11 aa, HIV-1
PLTEEAELELA

SEQ ID NO: 1515 - protein, 11 aa, HIV-1
EEAELELAENR

SEQ ID NO: 1516 - protein, 11 aa, HIV-1
AELELAENREI

SEQ ID NO: 1517 - protein, 11 aa, HIV-1
ELELAENREIL

SEQ ID NO: 1518 - protein, 11 aa, HIV-1
AENREILKEPV

SEQ ID NO: 1519 - protein, 11 aa, HIV-1
REILKEPVHGV

SEQ ID NO: 1520 - protein, 11 aa, HIV-1
EILKEPVHGVY

SEQ ID NO: 1521 - protein, 11 aa, HIV-1
ILKEPVHGVYY

SEQ ID NO: 1522 - protein, 11 aa, HIV-1
EPVHGVYYDPS

SEQ ID NO: 1523 - protein, 11 aa, HIV-1
PVHGVYYDPSK

SEQ ID NO: 1524 - protein, 11 aa, HIV-1
AEIQKQGQGQW

SEQ ID NO: 1525 - protein, 11 aa, HIV-1
IQKQGQGQWTY

SEQ ID NO: 1526 - protein, 11 aa, HIV-1
KQGQGQWTYQI

SEQ ID NO: 1527 - protein, 11 aa, HIV-1
QWTYQIYQEPF

SEQ ID NO: 1528 - protein, 11 aa, HIV-1
WTYQIYQEPFK

SEQ ID NO: 1529 - protein, 11 aa, HIV-1
YQIYQEPFKNL

SEQ ID NO: 1530 - protein, 11 aa, HIV-1
QIYQEPFKNLK

SEQ ID NO: 1531 - protein, 11 aa, HIV-1
EPFKNLKTGKY

SEQ ID NO: 1532 - protein, 11 aa, HIV-1
NLKTGKYARMR

SEQ ID NO: 1533 - protein, 11 aa, HIV-1
RMRGAHTNDVK

SEQ ID NO: 1534 - protein, 11 aa, HIV-1
HTNDVKQLTEA

SEQ ID NO: 1535 - protein, 11 aa, HIV-1
DVKQLTEAVQK

SEQ ID NO: 1536 - protein, 11 aa, HIV-1
QLTEAVQKITT

SEQ ID NO: 1537 - protein, 11 aa, HIV-1
EAVQKITTESI

SEQ ID NO: 1538 - protein, 11 aa, HIV-1
AVQKITTESIV

SEQ ID NO: 1539 - protein, 11 aa, HIV-1
ITTESIVIWGK

SEQ ID NO: 1540 - protein, 11 aa, HIV-1
ESIVIWGKTPK

SEQ ID NO: 1541 - protein, 11 aa, HIV-1
SIVIWGKTPKF

SEQ ID NO: 1542 - protein, 11 aa, HIV-1
IVIWGKTPKFK

SEQ ID NO: 1543 - protein, 11 aa, HIV-1
VIWGKTPKFKL

SEQ ID NO: 1544 - protein, 11 aa, HIV-1
KTPKFKLPIQK

SEQ ID NO: 1545 - protein, 11 aa, HIV-1
KLPIQKETWET

SEQ ID NO: 1546 - protein, 11 aa, HIV-1
LPIQKETWETW

SEQ ID NO: 1547 - protein, 11 aa, HIV-1
IQKETWETWWT

SEQ ID NO: 1548 - protein, 11 aa, HIV-1
KETWETWWTEY

SEQ ID NO: 1549 - protein, 11 aa, HIV-1
ETWETWWTEYW

SEQ ID NO: 1550 - protein, 11 aa, HIV-1
WETWWTEYWQA

SEQ ID NO: 1551 - protein, 11 aa, HIV-1
ETWWTEYWQAT

SEQ ID NO: 1552 - protein, 11 aa, HIV-1
TWWTEYWQATW

SEQ ID NO: 1553 - protein, 11 aa, HIV-1
WWTEYWQATWI

SEQ ID NO: 1554 - protein, 11 aa, HIV-1
EYWQATWIPEW

SEQ ID NO: 1555 - protein, 11 aa, HIV-1
WQATWIPEWEF

SEQ ID NO: 1556 - protein, 11 aa, HIV-1
QATWIPEWEFV

SEQ ID NO: 1557 - protein, 11 aa, HIV-1
PEWEFVNTPPL

SEQ ID NO: 1558 - protein, 11 aa, HIV-1
WEFVNTPPLVK

SEQ ID NO: 1559 - protein, 11 aa, HIV-1
EFVNTPPLVKL

SEQ ID NO: 1560 - protein, 11 aa, HIV-1
FVNTPPLVKLW

SEQ ID NO: 1561 - protein, 11 aa, HIV-1
KLWYQLEKEPI

SEQ ID NO: 1562 - protein, 11 aa, HIV-1
YQLEKEPIVGA

SEQ ID NO: 1563 - protein, 11 aa, HIV-1
EPIVGAETFYV

SEQ ID NO: 1564 - protein, 11 aa, HIV-1
ETFYVDGAANR

SEQ ID NO: 1565 - protein, 11 aa, HIV-1
YVDGAANRETK

SEQ ID NO: 1566 - protein, 11 aa, HIV-1
GAANRETKLGK

SEQ ID NO: 1567 - protein, 11 aa, HIV-1
RETKLGKAGYV

SEQ ID NO: 1568 - protein, 11 aa, HIV-1
KLGKAGYVTNR

SEQ ID NO: 1569 - protein, 11 aa, HIV-1
AGYVTNRGRQK

SEQ ID NO: 1570 - protein, 11 aa, HIV-1
YVTNRGRQKVV

SEQ ID NO: 1571 - protein, 11 aa, HIV-1
VVTLTDTTNQK

SEQ ID NO: 1572 - protein, 11 aa, HIV-1
LTDTTNQKTEL

SEQ ID NO: 1573 - protein, 11 aa, HIV-1
TTNQKTELQAI

SEQ ID NO: 1574 - protein, 11 aa, HIV-1
KTELQAIYLAL

SEQ ID NO: 1575 - protein, 11 aa, HIV-1
AIYLALQDSGL

SEQ ID NO: 1576 - protein, 11 aa, HIV-1
YLALQDSGLEV

SEQ ID NO: 1577 - protein, 11 aa, HIV-1
ALQDSGLEVNI

SEQ ID NO: 1578 - protein, 11 aa, HIV-1
LQDSGLEVNIV

SEQ ID NO: 1579 - protein, 11 aa, HIV-1
LEVNIVTDSQY

SEQ ID NO: 1580 - protein, 11 aa, HIV-1
EVNIVTDSQYA

SEQ ID NO: 1581 - protein, 11 aa, HIV-1
IVTDSQYALGI

SEQ ID NO: 1582 - protein, 11 aa, HIV-1
SQYALGIIQAQ

SEQ ID NO: 1583 - protein, 11 aa, HIV-1
AQPDQSESELV

SEQ ID NO: 1584 - protein, 11 aa, HIV-1
SELVNQIIEQL

SEQ ID NO: 1585 - protein, 11 aa, HIV-1
ELVNQIIEQLI

SEQ ID NO: 1586 - protein, 11 aa, HIV-1
LVNQIIEQLIK

SEQ ID NO: 1587 - protein, 11 aa, HIV-1
QIIEQLIKKEK

SEQ ID NO: 1588 - protein, 11 aa, HIV-1
IIEQLIKKEKV

SEQ ID NO: 1589 - protein, 11 aa, HIV-1
IEQLIKKEKVY

SEQ ID NO: 1590 - protein, 11 aa, HIV-1
QLIKKEKVYLA

SEQ ID NO: 1591 - protein, 11 aa, HIV-1
IKKEKVYLAWV

SEQ ID NO: 1592 - protein, 11 aa, HIV-1
KVYLAWVPAHK

SEQ ID NO: 1593 - protein, 11 aa, HIV-1
YLAWVPAHKGI

SEQ ID NO: 1594 - protein, 11 aa, HIV-1
GIGGNEQVDKL

SEQ ID NO: 1595 - protein, 11 aa, HIV-1
EQVDKLVSAGI

SEQ ID NO: 1596 - protein, 11 aa, HIV-1
QVDKLVSAGIR

SEQ ID NO: 1597 - protein, 11 aa, HIV-1
KLVSAGIRKVL

SEQ ID NO: 1598 - protein, 11 aa, HIV-1
LVSAGIRKVLF

SEQ ID NO: 1599 - protein, 11 aa, HIV-1
GIRKVLFLDGI

SEQ ID NO: 1600 - protein, 11 aa, HIV-1
FLDGIDKAQDE

SEQ ID NO: 1601 - protein, 11 aa, HIV-1
HSNWRAMASDF

SEQ ID NO: 1602 - protein, 11 aa, HIV-1
NWRAMASDFNL

SEQ ID NO: 1603 - protein, 11 aa, HIV-1
AMASDFNLPPV

SEQ ID NO: 1604 - protein, 11 aa, HIV-1
MASDFNLPPVV

SEQ ID NO: 1605 - protein, 11 aa, HIV-1
NLPPVVAKEIV

SEQ ID NO: 1606 - protein, 11 aa, HIV-1
LPPVVAKEIVA

SEQ ID NO: 1607 - protein, 11 aa, HIV-1
EIVASCDKCQL

SEQ ID NO: 1608 - protein, 11 aa, HIV-1
IVASCDKCQLK

SEQ ID NO: 1609 - protein, 11 aa, HIV-1
QLKGEAMHGQV

SEQ ID NO: 1610 - protein, 11 aa, HIV-1
QVDCSPGIWQL

SEQ ID NO: 1611 - protein, 11 aa, HIV-1
QLDCTHLEGKV

SEQ ID NO: 1612 - protein, 11 aa, HIV-1
HLEGKVILVAV

SEQ ID NO: 1613 - protein, 11 aa, HIV-1
ILVAVHVASGY

SEQ ID NO: 1614 - protein, 11 aa, HIV-1
LVAVHVASGYI

SEQ ID NO: 1615 - protein, 11 aa, HIV-1
AVHVASGYIEA

SEQ ID NO: 1616 - protein, 11 aa, HIV-1
HVASGYIEAEV

SEQ ID NO: 1617 - protein, 11 aa, HIV-1
IPAETGQETAY

SEQ ID NO: 1618 - protein, 11 aa, HIV-1
AETGQETAYFL

SEQ ID NO: 1619 - protein, 11 aa, HIV-1
ETGQETAYFLL

SEQ ID NO: 1620 - protein, 11 aa, HIV-1
TGQETAYFLLK

SEQ ID NO: 1621 - protein, 11 aa, HIV-1
GQETAYFLLKL

SEQ ID NO: 1622 - protein, 11 aa, HIV-1
TAYFLLKLAGR

SEQ ID NO: 1623 - protein, 11 aa, HIV-1
AYFLLKLAGRW

SEQ ID NO: 1624 - protein, 11 aa, HIV-1
FLLKLAGRWPV

SEQ ID NO: 1625 - protein, 11 aa, HIV-1
LLKLAGRWPVK

SEQ ID NO: 1626 - protein, 11 aa, HIV-1
KLAGRWPVKTI

SEQ ID NO: 1627 - protein, 11 aa, HIV-1
KTIHTDNGSNF

SEQ ID NO: 1628 - protein, 11 aa, HIV-1
HTDNGSNFTGA

SEQ ID NO: 1629 - protein, 11 aa, HIV-1
NGSNFTGATVR

SEQ ID NO: 1630 - protein, 11 aa, HIV-1
FTGATVRAACW

SEQ ID NO: 1631 - protein, 11 aa, HIV-1
TGATVRAACWW

SEQ ID NO: 1632 - protein, 11 aa, HIV-1
TVRAACWWAGI

SEQ ID NO: 1633 - protein, 11 aa, HIV-1
ACWWAGIKQEF

SEQ ID NO: 1634 - protein, 11 aa, HIV-1
WWAGIKQEFGI

SEQ ID NO: 1635 - protein, 11 aa, HIV-1
QEFGIPYNPQS

SEQ ID NO: 1636 - protein, 11 aa, HIV-1
GIPYNPQSQGV

SEQ ID NO: 1637 - protein, 11 aa, HIV-1
IPYNPQSQGVV

SEQ ID NO: 1638 - protein, 11 aa, HIV-1
NPQSQGVVESM

SEQ ID NO: 1639 - protein, 11 aa, HIV-1
QSQGVVESMNK

SEQ ID NO: 1640 - protein, 11 aa, HIV-1
GVVESMNKELK

SEQ ID NO: 1641 - protein, 11 aa, HIV-1
VVESMNKELKK

SEQ ID NO: 1642 - protein, 11 aa, HIV-1
KELKKIIGQVR

SEQ ID NO: 1643 - protein, 11 aa, HIV-1
GQVRDQAEHLK

SEQ ID NO: 1644 - protein, 11 aa, HIV-1
AEHLKTAVQMA

SEQ ID NO: 1645 - protein, 11 aa, HIV-1
HLKTAVQMAVF

SEQ ID NO: 1646 - protein, 11 aa, HIV-1
AVQMAVFIHNF

SEQ ID NO: 1647 - protein, 11 aa, HIV-1
VQMAVFIHNFK

SEQ ID NO: 1648 - protein, 11 aa, HIV-1
QMAVFIHNFKR

SEQ ID NO: 1649 - protein, 11 aa, HIV-1
MAVFIHNFKRK

SEQ ID NO: 1650 - protein, 11 aa, HIV-1
FIHNFKRKGGI

SEQ ID NO: 1651 - protein, 11 aa, HIV-1
GIGGYSAGERI

SEQ ID NO: 1652 - protein, 11 aa, HIV-1
GYSAGERIVDI

SEQ ID NO: 1653 - protein, 11 aa, HIV-1
YSAGERIVDII

SEQ ID NO: 1654 - protein, 11 aa, HIV-1
IIATDIQTKEL

SEQ ID NO: 1655 - protein, 11 aa, HIV-1
ATDIQTKELQK

SEQ ID NO: 1656 - protein, 11 aa, HIV-1
QTKELQKQITK

SEQ ID NO: 1657 - protein, 11 aa, HIV-1
LQKQITKIQNF

SEQ ID NO: 1658 - protein, 11 aa, HIV-1
KQITKIQNFRV

SEQ ID NO: 1659 - protein, 11 aa, HIV-1
QITKIQNFRVY

SEQ ID NO: 1660 - protein, 11 aa, HIV-1
ITKIQNFRVYY

SEQ ID NO: 1661 - protein, 11 aa, HIV-1
TKIQNFRVYYR

SEQ ID NO: 1662 - protein, 11 aa, HIV-1
QNFRVYYRDSR

SEQ ID NO: 1663 - protein, 11 aa, HIV-1
RVYYRDSRNPL

SEQ ID NO: 1664 - protein, 11 aa, HIV-1
VYYRDSRNPLW

SEQ ID NO: 1665 - protein, 11 aa, HIV-1
YYRDSRNPLWK

SEQ ID NO: 1666 - protein, 11 aa, HIV-1
SRNPLWKGPAK

SEQ ID NO: 1667 - protein, 11 aa, HIV-1
NPLWKGPAKLL

SEQ ID NO: 1668 - protein, 11 aa, HIV-1
KLLWKGEGAVV

SEQ ID NO: 1669 - protein, 11 aa, HIV-1
LLWKGEGAVVI

SEQ ID NO: 1670 - protein, 11 aa, HIV-1
AVVIQDNSDIK

SEQ ID NO: 1671 - protein, 11 aa, HIV-1
VVIQDNSDIKV

SEQ ID NO: 1672 - protein, 11 aa, HIV-1
VIQDNSDIKVV

SEQ ID NO: 1673 - protein, 11 aa, HIV-1
DNSDIKVVPRR

SEQ ID NO: 1674 - protein, 11 aa, HIV-1
DIKVVPRRKAK

SEQ ID NO: 1675 - protein, 11 aa, HIV-1
VVPRRKAKIIR

SEQ ID NO: 1676 - protein, 11 aa, HIV-1
KQMAGDDCVAS

SEQ ID NO: 1677 - protein, 11 aa, HIV-1
QMAGDDCVASR

SEQ ID NO: 1678 - protein, 15 aa, HIV-1
ADDTVLEEMSLPGRW

SEQ ID NO: 1679 - protein, 9 aa, HIV-1
LEEMSLPGR

SEQ ID NO: 1680 - protein, 15 aa, HIV-1
AEAMSQVTNSATIMM

SEQ ID NO: 1681 - protein, 9 aa, HIV-1
AMSQVTNSA

SEQ ID NO: 1682 - protein, 15 aa, HIV-1
AEAMSQVTNSATIMM

SEQ ID NO: 1683 - protein, 9 aa, HIV-1
MSQVTNSAT

SEQ ID NO: 1684 - protein, 15 aa, HIV-1
AEAMSQVTNSATIMM

SEQ ID NO: 1685 - protein, 9 aa, HIV-1
QVTNSATIM

SEQ ID NO: 1686 - protein, 15 aa, HIV-1
AEHLKTAVQMAVFIH

SEQ ID NO: 1687 - protein, 9 aa, HIV-1
LKTAVQMAV

SEQ ID NO: 1688 - protein, 15 aa, HIV-1
AENREILKEPVHGVY

SEQ ID NO: 1689 - protein, 9 aa, HIV-1
ILKEPVHGV

SEQ ID NO: 1690 - protein, 15 aa, HIV-1
AETFYVDGAANRETK

SEQ ID NO: 1691 - protein, 9 aa, HIV-1
YVDGAANRE

SEQ ID NO: 1692 - protein, 15 aa, HIV-1
AFLQGKAREFSSEQT

SEQ ID NO: 1693 - protein, 9 aa, HIV-1
LQGKAREFS

SEQ ID NO: 1694 - protein, 15 aa, HIV-1
AFSPEVIPMFSALSE

SEQ ID NO: 1695 - protein, 9 aa, HIV-1
VIPMFSALS

SEQ ID NO: 1696 - protein, 15 aa, HIV-1
AFTIPSINNETPGIR

SEQ ID NO: 1697 - protein, 9 aa, HIV-1
IPSINNETP

SEQ ID NO: 1698 - protein, 15 aa, HIV-1
AFTIPSINNETPGIR

SEQ ID NO: 1699 - protein, 9 aa, HIV-1
PSINNETPG

SEQ ID NO: 1700 - protein, 15 aa, HIV-1
AGERIVDIIATDIQT

SEQ ID NO: 1701 - protein, 9 aa, HIV-1
IVDIIATDI

SEQ ID NO: 1702 - protein, 15 aa, HIV-1
AGIKQEFGIPYNPQS

SEQ ID NO: 1703 - protein, 9 aa, HIV-1
IKQEFGIPY

SEQ ID NO: 1704 - protein, 15 aa, HIV-1
AGLKKKKSVTVLDVG

SEQ ID NO: 1705 - protein, 9 aa, HIV-1
LKKKKSVTV

SEQ ID NO: 1706 - protein, 15 aa, HIV-1
AGPIAPGQMREPRGS

SEQ ID NO: 1707 - protein, 9 aa, HIV-1
IAPGQMREP

SEQ ID NO: 1708 - protein, 15 aa, HIV-1
AGRWPVKTIHTDNGS

SEQ ID NO: 1709 - protein, 9 aa, HIV-1
VKTIHTDNG

SEQ ID NO: 1710 - protein, 15 aa, HIV-1
AGYVTNRGRQKVVTL

SEQ ID NO: 1711 - protein, 9 aa, HIV-1
VTNRGRQKV

SEQ ID NO: 1712 - protein, 15 aa, HIV-1
AGYVTNRGRQKVVTL

SEQ ID NO: 1713 - protein, 9 aa, HIV-1
YVTNRGRQK

SEQ ID NO: 1714 - protein, 15 aa, HIV-1
AIFQSSMTKILEPFR

SEQ ID NO: 1715 - protein, 9 aa, HIV-1
FQSSMTKIL

SEQ ID NO: 1716 - protein, 15 aa, HIV-1
AIGTVLVGPTPVNII

SEQ ID NO: 1717 - protein, 9 aa, HIV-1
IGTVLVGPT

SEQ ID NO: 1718 - protein, 15 aa, HIV-1
AIGTVLVGPTPVNII

SEQ ID NO: 1719 - protein, 9 aa, HIV-1
LVGPTPVNI

SEQ ID NO: 1720 - protein, 15 aa, HIV-1
AIGTVLVGPTPVNII

SEQ ID NO: 1721 - protein, 9 aa, HIV-1
VLVGPTPVN

SEQ ID NO: 1722 - protein, 15 aa, HIV-1
AISPRTLNAWVKVVE

SEQ ID NO: 1723 - protein, 9 aa, HIV-1
PRTLNAWVK

SEQ ID NO: 1724 - protein, 15 aa, HIV-1
AISPRTLNAWVKVVE

SEQ ID NO: 1725 - protein, 9 aa, HIV-1
TLNAWVKVV

SEQ ID NO: 1726 - protein, 15 aa, HIV-1
AIYLALQDSGLEVNI

SEQ ID NO: 1727 - protein, 9 aa, HIV-1
YLALQDSGL

SEQ ID NO: 1728 - protein, 15 aa, HIV-1
AKLLWKGEGAVVIQD

SEQ ID NO: 1729 - protein, 9 aa, HIV-1
WKGEGAVVI

SEQ ID NO: 1730 - protein, 15 aa, HIV-1
ALGIIQAQPDQSESE

SEQ ID NO: 1731 - protein, 9 aa, HIV-1
IIQAQPDQS

SEQ ID NO: 1732 - protein, 15 aa, HIV-1
ALGIIQAQPDQSESE

SEQ ID NO: 1733 - protein, 9 aa, HIV-1
IQAQPDQSE

SEQ ID NO: 1734 - protein, 15 aa, HIV-1
AMASDFNLPPVVAKE

SEQ ID NO: 1735 - protein, 9 aa, HIV-1
DFNLPPVVA

SEQ ID NO: 1736 - protein, 15 aa, HIV-1
AMASDFNLPPVVAKE

SEQ ID NO: 1737 - protein, 9 aa, HIV-1
MASDFNLPP

SEQ ID NO: 1738 - protein, 15 aa, HIV-1
AMSQVTNSATIMMQR

SEQ ID NO: 1739 - protein, 9 aa, HIV-1
AMSQVTNSA

SEQ ID NO: 1740 - protein, 15 aa, HIV-1
AMSQVTNSATIMMQR

SEQ ID NO: 1741 - protein, 9 aa, HIV-1
VTNSATIMM

SEQ ID NO: 1742 - protein, 15 aa, HIV-1
AREFSSEQTRANSPT

SEQ ID NO: 1743 - protein, 9 aa, HIV-1
FSSEQTRAN

SEQ ID NO: 1744 - protein, 15 aa, HIV-1
ARMRGAHTNDVKQLT

SEQ ID NO: 1745 - protein, 9 aa, HIV-1
MRGAHTNDV

SEQ ID NO: 1746 - protein, 15 aa, HIV-1
ARVLAEAMSQVTNSA

SEQ ID NO: 1747 - protein, 9 aa, HIV-1
LAEAMSQVT

SEQ ID NO: 1748 - protein, 15 aa, HIV-1
ARVLAEAMSQVTNSA

SEQ ID NO: 1749 - protein, 9 aa, HIV-1
VLAEAMSQV

SEQ ID NO: 1750 - protein, 15 aa, HIV-1
ASDFNLPPVVAKEIV

SEQ ID NO: 1751 - protein, 9 aa, HIV-1
DFNLPPVVA

SEQ ID NO: 1752 - protein, 15 aa, HIV-1
ASQEVKNWMTETLLV

SEQ ID NO: 1753 - protein, 9 aa, HIV-1
VKNWMTETL

SEQ ID NO: 1754 - protein, 15 aa, HIV-1
ASQIYPGIKVRQLCK

SEQ ID NO: 1755 - protein, 9 aa, HIV-1
YPGIKVRQL

SEQ ID NO: 1756 - protein, 15 aa, HIV-1
ASRELERFAVNPGLL

SEQ ID NO: 1757 - protein, 9 aa, HIV-1
LERFAVNPG

SEQ ID NO: 1758 - protein, 15 aa, HIV-1
ATDIQTKELQKQITK

SEQ ID NO: 1759 - protein, 9 aa, HIV-1
IQTKELQKQ

SEQ ID NO: 1760 - protein, 15 aa, HIV-1
ATIMMQRGNFRNQRK

SEQ ID NO: 1761 - protein, 9 aa, HIV-1
IMMQRGNFR

SEQ ID NO: 1762 - protein, 15 aa, HIV-1
ATLEEMMTACQGVGG

SEQ ID NO: 1763 - protein, 9 aa, HIV-1
LEEMMTACQ

SEQ ID NO: 1764 - protein, 15 aa, HIV-1
ATPQDLNTMLNTVGG

SEQ ID NO: 1765 - protein, 9 aa, HIV-1
LNTMLNTVG

SEQ ID NO: 1766 - protein, 15 aa, HIV-1
ATVRAACWWAGIKQE

SEQ ID NO: 1767 - protein, 9 aa, HIV-1
VRAACWWAG

SEQ ID NO: 1768 - protein, 15 aa, HIV-1
ATWIPEWEFVNTPPL

SEQ ID NO: 1769 - protein, 9 aa, HIV-1
ATWIPEWEF

SEQ ID NO: 1770 - protein, 15 aa, HIV-1
ATWIPEWEFVNTPPL

SEQ ID NO: 1771 - protein, 9 aa, HIV-1
PEWEFVNTP

SEQ ID NO: 1772 - protein, 15 aa, HIV-1
AVFIHNFKRKGGIGG

SEQ ID NO: 1773 - protein, 9 aa, HIV-1
FIHNFKRKG

SEQ ID NO: 1774 - protein, 15 aa, HIV-1
AVFIHNFKRKGGIGG

SEQ ID NO: 1775 - protein, 9 aa, HIV-1
IHNFKRKGG

SEQ ID NO: 1776 - protein, 15 aa, HIV-1
AVQKITTESIVIWGK

SEQ ID NO: 1777 - protein, 9 aa, HIV-1
VQKITTESI

SEQ ID NO: 1778 - protein, 15 aa, HIV-1
AVQMAVFIHNFKRKG

SEQ ID NO: 1779 - protein, 9 aa, HIV-1
VQMAVFIHN

SEQ ID NO: 1780 - protein, 15 aa, HIV-1
AYFLLKLAGRWPVKT

SEQ ID NO: 1781 - protein, 9 aa, HIV-1
LKLAGRWPV

SEQ ID NO: 1782 - protein, 15 aa, HIV-1
AYFLLKLAGRWPVKT

SEQ ID NO: 1783 - protein, 9 aa, HIV-1
LLKLAGRWP

SEQ ID NO: 1784 - protein, 15 aa, HIV-1
AYFLLKLAGRWPVKT

SEQ ID NO: 1785 - protein, 9 aa, HIV-1
YFLLKLAGR

SEQ ID NO: 1786 - protein, 15 aa, HIV-1
CDKCQLKGEAMHGQV

SEQ ID NO: 1787 - protein, 9 aa, HIV-1
LKGEAMHGQ

SEQ ID NO: 1788 - protein, 15 aa, HIV-1
CGHKAIGTVLVGPTP

SEQ ID NO: 1789 - protein, 9 aa, HIV-1
HKAIGTVLV

SEQ ID NO: 1790 - protein, 15 aa, HIV-1
CGHKAIGTVLVGPTP

SEQ ID NO: 1791 - protein, 9 aa, HIV-1
IGTVLVGPT

SEQ ID NO: 1792 - protein, 15 aa, HIV-1
CKLLRGTKALTEVIP

SEQ ID NO: 1793 - protein, 9 aa, HIV-1
LRGTKALTE

SEQ ID NO: 1794 - protein, 15 aa, HIV-1
CKTILKALGPAATLE

SEQ ID NO: 1795 - protein, 9 aa, HIV-1
ILKALGPAA

SEQ ID NO: 1796 - protein, 15 aa, HIV-1
CKTILKALGPAATLE

SEQ ID NO: 1797 - protein, 9 aa, HIV-1
LKALGPAAT

SEQ ID NO: 1798 - protein, 15 aa, HIV-1
CQLKGEAMHGQVDCS

SEQ ID NO: 1799 - protein, 9 aa, HIV-1
LKGEAMHGQ

SEQ ID NO: 1800 - protein, 15 aa, HIV-1
CRQILGQLQPSLQTG

SEQ ID NO: 1801 - protein, 9 aa, HIV-1
GQLQPSLQT

SEQ ID NO: 1802 - protein, 15 aa, HIV-1
CRQILGQLQPSLQTG

SEQ ID NO: 1803 - protein, 9 aa, HIV-1
LGQLQPSLQ

SEQ ID NO: 1804 - protein, 15 aa, HIV-1
CTHLEGKVILVAVHV

SEQ ID NO: 1805 - protein, 9 aa, HIV-1
LEGKVILVA

SEQ ID NO: 1806 - protein, 15 aa, HIV-1
CTLNFPISPIETVPV

SEQ ID NO: 1807 - protein, 9 aa, HIV-1
FPISPIETV

SEQ ID NO: 1808 - protein, 15 aa, HIV-1
DAYFSVPLDEDFRKY

SEQ ID NO: 1809 - protein, 9 aa, HIV-1
YFSVPLDED

SEQ ID NO: 1810 - protein, 15 aa, HIV-1
DCKTILKALGPAATL

SEQ ID NO: 1811 - protein, 9 aa, HIV-1
ILKALGPAA

SEQ ID NO: 1812 - protein, 15 aa, HIV-1
DCKTILKALGPAATL

SEQ ID NO: 1813 - protein, 9 aa, HIV-1
LKALGPAAT

SEQ ID NO: 1814 - protein, 15 aa, HIV-1
DDLYVGSDLEIGQHR

SEQ ID NO: 1815 - protein, 9 aa, HIV-1
YVGSDLEIG

SEQ ID NO: 1816 - protein, 15 aa, HIV-1
DDTVLEEMSLPGRWK

SEQ ID NO: 1817 - protein, 9 aa, HIV-1
LEEMSLPGR

SEQ ID NO: 1818 - protein, 15 aa, HIV-1
DEDFRKYTAFTIPSI

SEQ ID NO: 1819 - protein, 9 aa, HIV-1
FRKYTAFTI

SEQ ID NO: 1820 - protein, 15 aa, HIV-1
DEDFRKYTAFTIPSI

SEQ ID NO: 1821 - protein, 9 aa, HIV-1
KYTAFTIPS

SEQ ID NO: 1822 - protein, 15 aa, HIV-1
DEHEKYHSNWRAMAS

SEQ ID NO: 1823 - protein, 9 aa, HIV-1
EKYHSNWRA

SEQ ID NO: 1824 - protein, 15 aa, HIV-1
DEHEKYHSNWRAMAS

SEQ ID NO: 1825 - protein, 9 aa, HIV-1
YHSNWRAMA

SEQ ID NO: 1826 - protein, 15 aa, HIV-1
DFNLPPVVAKEIVAS

SEQ ID NO: 1827 - protein, 9 aa, HIV-1
DFNLPPVVA

SEQ ID NO: 1828 - protein, 15 aa, HIV-1
DFRKYTAFTIPSINN

SEQ ID NO: 1829 - protein, 9 aa, HIV-1
FRKYTAFTI

SEQ ID NO: 1830 - protein, 15 aa, HIV-1
DFRKYTAFTIPSINN

SEQ ID NO: 1831 - protein, 9 aa, HIV-1
YTAFTIPSI

SEQ ID NO: 1832 - protein, 15 aa, HIV-1
DFWEVQLGIPHPAGL

SEQ ID NO: 1833 - protein, 9 aa, HIV-1
VQLGIPHPA

SEQ ID NO: 1834 - protein, 15 aa, HIV-1
DGPKVKQWPLTEEKI

SEQ ID NO: 1835 - protein, 9 aa, HIV-1
VKQWPLTEE

SEQ ID NO: 1836 - protein, 15 aa, HIV-1
DIAGTTSTLQEQIGW

SEQ ID NO: 1837 - protein, 9 aa, HIV-1
IAGTTSTLQ

SEQ ID NO: 1838 - protein, 15 aa, HIV-1
DIIATDIQTKELQKQ

SEQ ID NO: 1839 - protein, 9 aa, HIV-1
ATDIQTKEL

SEQ ID NO: 1840 - protein, 15 aa, HIV-1
DIKVVPRRKAKIIRD

SEQ ID NO: 1841 - protein, 9 aa, HIV-1
IKVVPRRKA

SEQ ID NO: 1842 - protein, 15 aa, HIV-1
DIQKLVGKLNWASQI

SEQ ID NO: 1843 - protein, 9 aa, HIV-1
LVGKLNWAS

SEQ ID NO: 1844 - protein, 15 aa, HIV-1
DIQTKELQKQITKIQ

SEQ ID NO: 1845 - protein, 9 aa, HIV-1
IQTKELQKQ

SEQ ID NO: 1846 - protein, 15 aa, HIV-1
DIVIYQYMDDLYVGS

SEQ ID NO: 1847 - protein, 9 aa, HIV-1
YQYMDDLYV

SEQ ID NO: 1848 - protein, 15 aa, HIV-1
DKCQLKGEAMHGQVD

SEQ ID NO: 1849 - protein, 9 aa, HIV-1
LKGEAMHGQ

SEQ ID NO: 1850 - protein, 15 aa, HIV-1
DKLVSAGIRKVLFLD

SEQ ID NO: 1851 - protein, 9 aa, HIV-1
LVSAGIRKV

SEQ ID NO: 1852 - protein, 15 aa, HIV-1
DKWTVQPIVLPEKDS

SEQ ID NO: 1853 - protein, 9 aa, HIV-1
WTVQPIVLP

SEQ ID NO: 1854 - protein, 15 aa, HIV-1
DLAFLQGKAREFSSE

SEQ ID NO: 1855 - protein, 9 aa, HIV-1
FLQGKAREF

SEQ ID NO: 1856 - protein, 15 aa, HIV-1
DLNTMLNTVGGHQAA

SEQ ID NO: 1857 - protein, 9 aa, HIV-1
LNTMLNTVG

SEQ ID NO: 1858 - protein, 15 aa, HIV-1
DLNTMLNTVGGHQAA

SEQ ID NO: 1859 - protein, 9 aa, HIV-1
MLNTVGGHQ

SEQ ID NO: 1860 - protein, 15 aa, HIV-1
DLYVGSDLEIGQHRT

SEQ ID NO: 1861 - protein, 9 aa, HIV-1
YVGSDLEIG

SEQ ID NO: 1862 - protein, 15 aa, HIV-1
DNGSNFTGATVRAAC

SEQ ID NO: 1863 - protein, 9 aa, HIV-1
FTGATVRAA

SEQ ID NO: 1864 - protein, 15 aa, HIV-1
DNSDIKVVPRRKAKI

SEQ ID NO: 1865 - protein, 9 aa, HIV-1
IKVVPRRKA

SEQ ID NO: 1866 - protein, 15 aa, HIV-1
DQAEHLKTAVQMAVF

SEQ ID NO: 1867 - protein, 9 aa, HIV-1
LKTAVQMAV

SEQ ID NO: 1868 - protein, 15 aa, HIV-1
DQILIEICGHKAIGT

SEQ ID NO: 1869 - protein, 9 aa, HIV-1
LIEICGHKA

SEQ ID NO: 1870 - protein, 15 aa, HIV-1
DRFYKTLRAEQASQE

SEQ ID NO: 1871 - protein, 9 aa, HIV-1
DRFYKTLRA

SEQ ID NO: 1872 - protein, 15 aa, HIV-1
DRFYKTLRAEQASQE

SEQ ID NO: 1873 - protein, 9 aa, HIV-1
FYKTLRAEQ

SEQ ID NO: 1874 - protein, 15 aa, HIV-1
DRFYKTLRAEQASQE

SEQ ID NO: 1875 - protein, 9 aa, HIV-1
YKTLRAEQA

SEQ ID NO: 1876 - protein, 15 aa, HIV-1
DRVHPVHAGPIAPGQ

SEQ ID NO: 1877 - protein, 9 aa, HIV-1
VHAGPIAPG

SEQ ID NO: 1878 - protein, 15 aa, HIV-1
DSGLEVNIVTDSQYA

SEQ ID NO: 1879 - protein, 9 aa, HIV-1
LEVNIVTDS

SEQ ID NO: 1880 - protein, 15 aa, HIV-1
DSQYALGIIQAQPDQ

SEQ ID NO: 1881 - protein, 9 aa, HIV-1
YALGIIQAQ

SEQ ID NO: 1882 - protein, 15 aa, HIV-1
DSRNPLWKGPAKLLW

SEQ ID NO: 1883 - protein, 9 aa, HIV-1
LWKGPAKLL

SEQ ID NO: 1884 - protein, 15 aa, HIV-1
DTVLEEMSLPGRWKP

SEQ ID NO: 1885 - protein, 9 aa, HIV-1
LEEMSLPGR

SEQ ID NO: 1886 - protein, 15 aa, HIV-1
DVGDAYFSVPLDEDF

SEQ ID NO: 1887 - protein, 9 aa, HIV-1
YFSVPLDED

SEQ ID NO: 1888 - protein, 15 aa, HIV-1
DYVDRFYKTLRAEQA

SEQ ID NO: 1889 - protein, 9 aa, HIV-1
DRFYKTLRA

SEQ ID NO: 1890 - protein, 15 aa, HIV-1
DYVDRFYKTLRAEQA

SEQ ID NO: 1891 - protein, 9 aa, HIV-1
FYKTLRAEQ

SEQ ID NO: 1892 - protein, 15 aa, HIV-1
DYVDRFYKTLRAEQA

SEQ ID NO: 1893 - protein, 9 aa, HIV-1
VDRFYKTLR

SEQ ID NO: 1894 - protein, 15 aa, HIV-1
DYVDRFYKTLRAEQA

SEQ ID NO: 1895 - protein, 9 aa, HIV-1
YVDRFYKTL

SEQ ID NO: 1896 - protein, 15 aa, HIV-1
EAMSQVTNSATIMMQ

SEQ ID NO: 1897 - protein, 9 aa, HIV-1
AMSQVTNSA

SEQ ID NO: 1898 - protein, 15 aa, HIV-1
EAMSQVTNSATIMMQ

SEQ ID NO: 1899 - protein, 9 aa, HIV-1
VTNSATIMM

SEQ ID NO: 1900 - protein, 15 aa, HIV-1
EAVQKITTESIVIWG

SEQ ID NO: 1901 - protein, 9 aa, HIV-1
VQKITTESI

SEQ ID NO: 1902 - protein, 15 aa, HIV-1
EDFRKYTAFTIPSIN

SEQ ID NO: 1903 - protein, 9 aa, HIV-1
FRKYTAFTI

SEQ ID NO: 1904 - protein, 15 aa, HIV-1
EDFRKYTAFTIPSIN

SEQ ID NO: 1905 - protein, 9 aa, HIV-1
YTAFTIPSI

SEQ ID NO: 1906 - protein, 15 aa, HIV-1
EDLAFLQGKAREFSS

SEQ ID NO: 1907 - protein, 9 aa, HIV-1
FLQGKAREF

SEQ ID NO: 1908 - protein, 15 aa, HIV-1
EDLAFLQGKAREFSS

SEQ ID NO: 1909 - protein, 9 aa, HIV-1
LAFLQGKAR

SEQ ID NO: 1910 - protein, 15 aa, HIV-1
EEKIKALVEICTEME

SEQ ID NO: 1911 - protein, 9 aa, HIV-1
IKALVEICT

SEQ ID NO: 1912 - protein, 15 aa, HIV-1
EELRQHLLRWGLTTP

SEQ ID NO: 1913 - protein, 9 aa, HIV-1
LRQHLLRWG

SEQ ID NO: 1914 - protein, 15 aa, HIV-1
EELRSLYNTVATLYC

SEQ ID NO: 1915 - protein, 9 aa, HIV-1
LRSLYNTVA

SEQ ID NO: 1916 - protein, 15 aa, HIV-1
EELRSLYNTVATLYC

SEQ ID NO: 1917 - protein, 9 aa, HIV-1
LYNTVATLY

SEQ ID NO: 1918 - protein, 15 aa, HIV-1
EFGIPYNPQSQGVVE

SEQ ID NO: 1919 - protein, 9 aa, HIV-1
PYNPQSQGV

SEQ ID NO: 1920 - protein, 15 aa, HIV-1
EFSSEQTRANSPTRR

SEQ ID NO: 1921 - protein, 9 aa, HIV-1
FSSEQTRAN

SEQ ID NO: 1922 - protein, 15 aa, HIV-1
EFSSEQTRANSPTRR

SEQ ID NO: 1923 - protein, 9 aa, HIV-1
QTRANSPTR

SEQ ID NO: 1924 - protein, 15 aa, HIV-1
EFVNTPPLVKLWYQL

SEQ ID NO: 1925 - protein, 9 aa, HIV-1
FVNTPPLVK

SEQ ID NO: 1926 - protein, 15 aa, HIV-1
EFVNTPPLVKLWYQL

SEQ ID NO: 1927 - protein, 9 aa, HIV-1
VNTPPLVKL

SEQ ID NO: 1928 - protein, 15 aa, HIV-1
EGCRQILGQLQPSLQ

SEQ ID NO: 1929 - protein, 9 aa, HIV-1
CRQILGQLQ

SEQ ID NO: 1930 - protein, 15 aa, HIV-1
EGCRQILGQLQPSLQ

SEQ ID NO: 1931 - protein, 9 aa, HIV-1
ILGQLQPSL

SEQ ID NO: 1932 - protein, 15 aa, HIV-1
EGCRQILGQLQPSLQ

SEQ ID NO: 1933 - protein, 9 aa, HIV-1
RQILGQLQP

SEQ ID NO: 1934 - protein, 15 aa, HIV-1
EGKISKIGPENPYNT

SEQ ID NO: 1935 - protein, 9 aa, HIV-1
ISKIGPENP

SEQ ID NO: 1936 - protein, 15 aa, HIV-1
EGKVILVAVHVASGY

SEQ ID NO: 1937 - protein, 9 aa, HIV-1
LVAVHVASG

SEQ ID NO: 1938 - protein, 15 aa, HIV-1
EGKVILVAVHVASGY

SEQ ID NO: 1939 - protein, 9 aa, HIV-1
VILVAVHVA

SEQ ID NO: 1940 - protein, 15 aa, HIV-1
EHEKYHSNWRAMASD

SEQ ID NO: 1941 - protein, 9 aa, HIV-1
HSNWRAMAS

SEQ ID NO: 1942 - protein, 15 aa, HIV-1
EHEKYHSNWRAMASD

SEQ ID NO: 1943 - protein, 9 aa, HIV-1
YHSNWRAMA

SEQ ID NO: 1944 - protein, 15 aa, HIV-1
EHLKTAVQMAVFIHN

SEQ ID NO: 1945 - protein, 9 aa, HIV-1
LKTAVQMAV

SEQ ID NO: 1946 - protein, 15 aa, HIV-1
EICGHKAIGTVLVGP

SEQ ID NO: 1947 - protein, 9 aa, HIV-1
HKAIGTVLV

SEQ ID NO: 1948 - protein, 15 aa, HIV-1
EIYKRWIILGLNKIV

SEQ ID NO: 1949 - protein, 9 aa, HIV-1
WIILGLNKI

SEQ ID NO: 1950 - protein, 15 aa, HIV-1
EIYKRWIILGLNKIV

SEQ ID NO: 1951 - protein, 9 aa, HIV-1
YKRWIILGL

SEQ ID NO: 1952 - protein, 15 aa, HIV-1
EKEPIVGAETFYVDG

SEQ ID NO: 1953 - protein, 9 aa, HIV-1
IVGAETFYV

SEQ ID NO: 1954 - protein, 15 aa, HIV-1
EKIKALVEICTEMEK

SEQ ID NO: 1955 - protein, 9 aa, HIV-1
IKALVEICT

SEQ ID NO: 1956 - protein, 15 aa, HIV-1
EKVYLAWVPAHKGIG

SEQ ID NO: 1957 - protein, 9 aa, HIV-1
LAWVPAHKG

SEQ ID NO: 1958 - protein, 15 aa, HIV-1
EKVYLAWVPAHKGIG

SEQ ID NO: 1959 - protein, 9 aa, HIV-1
VYLAWVPAH

SEQ ID NO: 1960 - protein, 15 aa, HIV-1
EKVYLAWVPAHKGIG

SEQ ID NO: 1961 - protein, 9 aa, HIV-1
YLAWVPAHK

SEQ ID NO: 1962 - protein, 15 aa, HIV-1
EKYHSNWRAMASDFN

SEQ ID NO: 1963 - protein, 9 aa, HIV-1
HSNWRAMAS

SEQ ID NO: 1964 - protein, 15 aa, HIV-1
EKYHSNWRAMASDFN

SEQ ID NO: 1965 - protein, 9 aa, HIV-1
YHSNWRAMA

SEQ ID NO: 1966 - protein, 15 aa, HIV-1
ELERFAVNPGLLETS

SEQ ID NO: 1967 - protein, 9 aa, HIV-1
FAVNPGLLE

SEQ ID NO: 1968 - protein, 15 aa, HIV-1
ELHPDKWTVQPIVLP

SEQ ID NO: 1969 - protein, 9 aa, HIV-1
DKWTVQPIV

SEQ ID NO: 1970 - protein, 15 aa, HIV-1
ELHPDKWTVQPIVLP

SEQ ID NO: 1971 - protein, 9 aa, HIV-1
KWTVQPIVL

SEQ ID NO: 1972 - protein, 15 aa, HIV-1
ELQAIYLALQDSGLE

SEQ ID NO: 1973 - protein, 9 aa, HIV-1
LQAIYLALQ

SEQ ID NO: 1974 - protein, 15 aa, HIV-1
ELQKQITKIQNFRVY

SEQ ID NO: 1975 - protein, 9 aa, HIV-1
ITKIQNFRV

SEQ ID NO: 1976 - protein, 15 aa, HIV-1
ELQKQITKIQNFRVY

SEQ ID NO: 1977 - protein, 9 aa, HIV-1
LQKQITKIQ

SEQ ID NO: 1978 - protein, 15 aa, HIV-1
ELRQHLLRWGLTTPD

SEQ ID NO: 1979 - protein, 9 aa, HIV-1
LLRWGLTTP

SEQ ID NO: 1980 - protein, 15 aa, HIV-1
ELRQHLLRWGLTTPD

SEQ ID NO: 1981 - protein, 9 aa, HIV-1
LRQHLLRWG

SEQ ID NO: 1982 - protein, 15 aa, HIV-1
ELRSLYNTVATLYCV

SEQ ID NO: 1983 - protein, 9 aa, HIV-1
LYNTVATLY

SEQ ID NO: 1984 - protein, 15 aa, HIV-1
ELRSLYNTVATLYCV

SEQ ID NO: 1985 - protein, 9 aa, HIV-1
YNTVATLYC

SEQ ID NO: 1986 - protein, 15 aa, HIV-1
ELVNQIIEQLIKKEK

SEQ ID NO: 1987 - protein, 9 aa, HIV-1
VNQIIEQLI

SEQ ID NO: 1988 - protein, 15 aa, HIV-1
ENREILKEPVHGVYY

SEQ ID NO: 1989 - protein, 9 aa, HIV-1
ILKEPVHGV

SEQ ID NO: 1990 - protein, 15 aa, HIV-1
EPFKNLKTGKYARMR

SEQ ID NO: 1991 - protein, 9 aa, HIV-1
FKNLKTGKY

SEQ ID NO: 1992 - protein, 15 aa, HIV-1
EPFKNLKTGKYARMR

SEQ ID NO: 1993 - protein, 9 aa, HIV-1
LKTGKYARM

SEQ ID NO: 1994 - protein, 15 aa, HIV-1
EPFRKQNPDIVIYQY

SEQ ID NO: 1995 - protein, 9 aa, HIV-1
FRKQNPDIV

SEQ ID NO: 1996 - protein, 15 aa, HIV-1
EPIVGAETFYVDGAA

SEQ ID NO: 1997 - protein, 9 aa, HIV-1
IVGAETFYV

SEQ ID NO: 1998 - protein, 15 aa, HIV-1
EPPFLWMGYELHPDK

SEQ ID NO: 1999 - protein, 9 aa, HIV-1
FLWMGYELH

SEQ ID NO: 2000 - protein, 15 aa, HIV-1
EPRGSDIAGTTSTLQ

SEQ ID NO: 2001 - protein, 9 aa, HIV-1
EPRGSDIAG

SEQ ID NO: 2002 - protein, 15 aa, HIV-1
EPRGSDIAGTTSTLQ

SEQ ID NO: 2003 - protein, 9 aa, HIV-1
GSDIAGTTS

SEQ ID NO: 2004 - protein, 15 aa, HIV-1
EPRGSDIAGTTSTLQ

SEQ ID NO: 2005 - protein, 9 aa, HIV-1
RGSDIAGTT

SEQ ID NO: 2006 - protein, 15 aa, HIV-1
EQASQEVKNWMTETL

SEQ ID NO: 2007 - protein, 9 aa, HIV-1
EVKNWMTET

SEQ ID NO: 2008 - protein, 15 aa, HIV-1
EQASQEVKNWMTETL

SEQ ID NO: 2009 - protein, 9 aa, HIV-1
SQEVKNWMT

SEQ ID NO: 2010 - protein, 15 aa, HIV-1
EQIGWMTNNPPIPVG

SEQ ID NO: 2011 - protein, 9 aa, HIV-1
IGWMTNNPP

SEQ ID NO: 2012 - protein, 15 aa, HIV-1
EQIGWMTNNPPIPVG

SEQ ID NO: 2013 - protein, 9 aa, HIV-1
MTNNPPIPV

SEQ ID NO: 2014 - protein, 15 aa, HIV-1
EQLIKKEKVYLAWVP

SEQ ID NO: 2015 - protein, 9 aa, HIV-1
IKKEKVYLA

SEQ ID NO: 2016 - protein, 15 aa, HIV-1
EQVDKLVSAGIRKVL

SEQ ID NO: 2017 - protein, 9 aa, HIV-1
LVSAGIRKV

SEQ ID NO: 2018 - protein, 15 aa, HIV-1
ERFAVNPGLLETSEG

SEQ ID NO: 2019 - protein, 9 aa, HIV-1
FAVNPGLLE

SEQ ID NO: 2020 - protein, 15 aa, HIV-1
ERFAVNPGLLETSEG

SEQ ID NO: 2021 - protein, 9 aa, HIV-1
VNPGLLETS

SEQ ID NO: 2022 - protein, 15 aa, HIV-1
ERIVDIIATDIQTKE

SEQ ID NO: 2023 - protein, 9 aa, HIV-1
IVDIIATDI

SEQ ID NO: 2024 - protein, 15 aa, HIV-1
ESELVNQIIEQLIKK

SEQ ID NO: 2025 - protein, 9 aa, HIV-1
LVNQIIEQL

SEQ ID NO: 2026 - protein, 15 aa, HIV-1
ESIVIWGKTPKFKLP

SEQ ID NO: 2027 - protein, 9 aa, HIV-1
IVIWGKTPK

SEQ ID NO: 2028 - protein, 15 aa, HIV-1
ESIVIWGKTPKFKLP

SEQ ID NO: 2029 - protein, 9 aa, HIV-1
IWGKTPKFK

SEQ ID NO: 2030 - protein, 15 aa, HIV-1
ESIVIWGKTPKFKLP

SEQ ID NO: 2031 - protein, 9 aa, HIV-1
VIWGKTPKF

SEQ ID NO: 2032 - protein, 15 aa, HIV-1
ESMNKELKKIIGQVR

SEQ ID NO: 2033 - protein, 9 aa, HIV-1
MNKELKKII

SEQ ID NO: 2034 - protein, 15 aa, HIV-1
ETAYFLLKLAGRWPV

SEQ ID NO: 2035 - protein, 9 aa, HIV-1
AYFLLKLAG

SEQ ID NO: 2036 - protein, 15 aa, HIV-1
ETAYFLLKLAGRWPV

SEQ ID NO: 2037 - protein, 9 aa, HIV-1
FLLKLAGRW

SEQ ID NO: 2038 - protein, 15 aa, HIV-1
ETAYFLLKLAGRWPV

SEQ ID NO: 2039 - protein, 9 aa, HIV-1
YFLLKLAGR

SEQ ID NO: 2040 - protein, 15 aa, HIV-1
ETFYVDGAANRETKL

SEQ ID NO: 2041 - protein, 9 aa, HIV-1
YVDGAANRE

SEQ ID NO: 2042 - protein, 15 aa, HIV-1
ETLLVQNANPDCKTI

SEQ ID NO: 2043 - protein, 9 aa, HIV-1
VQNANPDCK

SEQ ID NO: 2044 - protein, 15 aa, HIV-1
ETPGIRYQYNVLPQG

SEQ ID NO: 2045 - protein, 9 aa, HIV-1
IRYQYNVLP

SEQ ID NO: 2046 - protein, 15 aa, HIV-1
ETVPVKLKPGMDGPK

SEQ ID NO: 2047 - protein, 9 aa, HIV-1
VKLKPGMDG

SEQ ID NO: 2048 - protein, 15 aa, HIV-1
ETWETWWTEYWQATW

SEQ ID NO: 2049 - protein, 9 aa, HIV-1
WETWWTEYW

SEQ ID NO: 2050 - protein, 15 aa, HIV-1
ETWWTEYWQATWIPE

SEQ ID NO: 2051 - protein, 9 aa, HIV-1
EYWQATWIP

SEQ ID NO: 2052 - protein, 15 aa, HIV-1
ETWWTEYWQATWIPE

SEQ ID NO: 2053 - protein, 9 aa, HIV-1
WWTEYWQAT

SEQ ID NO: 2054 - protein, 15 aa, HIV-1
EVIPMFSALSEGATP

SEQ ID NO: 2055 - protein, 9 aa, HIV-1
IPMFSALSE

SEQ ID NO: 2056 - protein, 15 aa, HIV-1
EVIPMFSALSEGATP

SEQ ID NO: 2057 - protein, 9 aa, HIV-1
MFSALSEGA

SEQ ID NO: 2058 - protein, 15 aa, HIV-1
EVIPMFSALSEGATP

SEQ ID NO: 2059 - protein, 9 aa, HIV-1
VIPMFSALS

SEQ ID NO: 2060 - protein, 15 aa, HIV-1
EVKNWMTETLLVQNA

SEQ ID NO: 2061 - protein, 9 aa, HIV-1
NWMTETLLV

SEQ ID NO: 2062 - protein, 15 aa, HIV-1
EVKNWMTETLLVQNA

SEQ ID NO: 2063 - protein, 9 aa, HIV-1
WMTETLLVQ

SEQ ID NO: 2064 - protein, 15 aa, HIV-1
EVQLGIPHPAGLKKK

SEQ ID NO: 2065 - protein, 9 aa, HIV-1
VQLGIPHPA

SEQ ID NO: 2066 - protein, 15 aa, HIV-1
EWEFVNTPPLVKLWY

SEQ ID NO: 2067 - protein, 9 aa, HIV-1
FVNTPPLVK

SEQ ID NO: 2068 - protein, 15 aa, HIV-1
EWEFVNTPPLVKLWY

SEQ ID NO: 2069 - protein, 9 aa, HIV-1
VNTPPLVKL

SEQ ID NO: 2070 - protein, 15 aa, HIV-1
EWEFVNTPPLVKLWY

SEQ ID NO: 2071 - protein, 9 aa, HIV-1
WEFVNTPPL

SEQ ID NO: 2072 - protein, 15 aa, HIV-1
EYWQATWIPEWEFVN

SEQ ID NO: 2073 - protein, 9 aa, HIV-1
WQATWIPEW

SEQ ID NO: 2074 - protein, 15 aa, HIV-1
FAIKKKDSTKWRKLV

SEQ ID NO: 2075 - protein, 9 aa, HIV-1
IKKKDSTKW

SEQ ID NO: 2076 - protein, 15 aa, HIV-1
FAVNPGLLETSEGCR

SEQ ID NO: 2077 - protein, 9 aa, HIV-1
VNPGLLETS

SEQ ID NO: 2078 - protein, 15 aa, HIV-1
FGIPYNPQSQGVVES

SEQ ID NO: 2079 - protein, 9 aa, HIV-1
PYNPQSQGV

SEQ ID NO: 2080 - protein, 15 aa, HIV-1
FIHNFKRKGGIGGYS

SEQ ID NO: 2081 - protein, 9 aa, HIV-1
FKRKGGIGG

SEQ ID NO: 2082 - protein, 15 aa, HIV-1
FKNLKTGKYARMRGA

SEQ ID NO: 2083 - protein, 9 aa, HIV-1
FKNLKTGKY

SEQ ID NO: 2084 - protein, 15 aa, HIV-1
FKNLKTGKYARMRGA

SEQ ID NO: 2085 - protein, 9 aa, HIV-1
LKTGKYARM

SEQ ID NO: 2086 - protein, 15 aa, HIV-1
FKRKGGIGGYSAGER

SEQ ID NO: 2087 - protein, 9 aa, HIV-1
FKRKGGIGG

SEQ ID NO: 2088 - protein, 15 aa, HIV-1
FLLKLAGRWPVKTIH

SEQ ID NO: 2089 - protein, 9 aa, HIV-1
KLAGRWPVK

SEQ ID NO: 2090 - protein, 15 aa, HIV-1
FLLKLAGRWPVKTIH

SEQ ID NO: 2091 - protein, 9 aa, HIV-1
LAGRWPVKT

SEQ ID NO: 2092 - protein, 15 aa, HIV-1
FLLKLAGRWPVKTIH

SEQ ID NO: 2093 - protein, 9 aa, HIV-1
LKLAGRWPV

SEQ ID NO: 2094 - protein, 15 aa, HIV-1
FLQGKAREFSSEQTR

SEQ ID NO: 2095 - protein, 9 aa, HIV-1
FLQGKAREF

SEQ ID NO: 2096 - protein, 15 aa, HIV-1
FLREDLAFLQGKARE

SEQ ID NO: 2097 - protein, 9 aa, HIV-1
LAFLQGKAR

SEQ ID NO: 2098 - protein, 15 aa, HIV-1
FNFPQVTLWQRPLVT

SEQ ID NO: 2099 - protein, 9 aa, HIV-1
FPQVTLWQR

SEQ ID NO: 2100 - protein, 15 aa, HIV-1
FNFPQVTLWQRPLVT

SEQ ID NO: 2101 - protein, 9 aa, HIV-1
VTLWQRPLV

SEQ ID NO: 2102 - protein, 15 aa, HIV-1
FNLPPVVAKEIVASC

SEQ ID NO: 2103 - protein, 9 aa, HIV-1
VVAKEIVAS

SEQ ID NO: 2104 - protein, 15 aa, HIV-1
FPISPIETVPVKLKP

SEQ ID NO: 2105 - protein, 9 aa, HIV-1
IETVPVKLK

SEQ ID NO: 2106 - protein, 15 aa, HIV-1
FPISPIETVPVKLKP

SEQ ID NO: 2107 - protein, 9 aa, HIV-1
ISPIETVPV

SEQ ID NO: 2108 - protein, 15 aa, HIV-1
FPQVTLWQRPLVTIK

SEQ ID NO: 2109 - protein, 9 aa, HIV-1
LWQRPLVTI

SEQ ID NO: 2110 - protein, 15 aa, HIV-1
FPQVTLWQRPLVTIK

SEQ ID NO: 2111 - protein, 9 aa, HIV-1
TLWQRPLVT

SEQ ID NO: 2112 - protein, 15 aa, HIV-1
FPQVTLWQRPLVTIK

SEQ ID NO: 2113 - protein, 9 aa, HIV-1
VTLWQRPLV

SEQ ID NO: 2114 - protein, 15 aa, HIV-1
FQSSMTKILEPFRKQ

SEQ ID NO: 2115 - protein, 9 aa, HIV-1
FQSSMTKIL

SEQ ID NO: 2116 - protein, 15 aa, HIV-1
FQSSMTKILEPFRKQ

SEQ ID NO: 2117 - protein, 9 aa, HIV-1
TKILEPFRK

SEQ ID NO: 2118 - protein, 15 aa, HIV-1
FRKQNPDIVIYQYMD

SEQ ID NO: 2119 - protein, 9 aa, HIV-1
FRKQNPDIV

SEQ ID NO: 2120 - protein, 15 aa, HIV-1
FRKYTAFTIPSINNE

SEQ ID NO: 2121 - protein, 9 aa, HIV-1
FRKYTAFTI

SEQ ID NO: 2122 - protein, 15 aa, HIV-1
FRKYTAFTIPSINNE

SEQ ID NO: 2123 - protein, 9 aa, HIV-1
YTAFTIPSI

SEQ ID NO: 2124 - protein, 15 aa, HIV-1
FRNQRKIVKCFNCGK

SEQ ID NO: 2125 - protein, 9 aa, HIV-1
FRNQRKIVK

SEQ ID NO: 2126 - protein, 15 aa, HIV-1
FRVYYRDSRNPLWKG

SEQ ID NO: 2127 - protein, 9 aa, HIV-1
FRVYYRDSR

SEQ ID NO: 2128 - protein, 15 aa, HIV-1
FRVYYRDSRNPLWKG

SEQ ID NO: 2129 - protein, 9 aa, HIV-1
YRDSRNPLW

SEQ ID NO: 2130 - protein, 15 aa, HIV-1
FRVYYRDSRNPLWKG

SEQ ID NO: 2131 - protein, 9 aa, HIV-1
YYRDSRNPL

SEQ ID NO: 2132 - protein, 15 aa, HIV-1
FSPEVIPMFSALSEG

SEQ ID NO: 2133 - protein, 9 aa, HIV-1
VIPMFSALS

SEQ ID NO: 2134 - protein, 15 aa, HIV-1
FSSEQTRANSPTRRE

SEQ ID NO: 2135 - protein, 9 aa, HIV-1
FSSEQTRAN

SEQ ID NO: 2136 - protein, 15 aa, HIV-1
FSSEQTRANSPTRRE

SEQ ID NO: 2137 - protein, 9 aa, HIV-1
QTRANSPTR

SEQ ID NO: 2138 - protein, 15 aa, HIV-1
FSSEQTRANSPTRRE

SEQ ID NO: 2139 - protein, 9 aa, HIV-1
TRANSPTRR

SEQ ID NO: 2140 - protein, 15 aa, HIV-1
FTGATVRAACWWAGI

SEQ ID NO: 2141 - protein, 9 aa, HIV-1
FTGATVRAA

SEQ ID NO: 2142 - protein, 15 aa, HIV-1
FTIPSINNETPGIRY

SEQ ID NO: 2143 - protein, 9 aa, HIV-1
INNETPGIR

SEQ ID NO: 2144 - protein, 15 aa, HIV-1
FVNTPPLVKLWYQLE

SEQ ID NO: 2145 - protein, 9 aa, HIV-1
FVNTPPLVK

SEQ ID NO: 2146 - protein, 15 aa, HIV-1
FVNTPPLVKLWYQLE

SEQ ID NO: 2147 - protein, 9 aa, HIV-1
VNTPPLVKL

SEQ ID NO: 2148 - protein, 15 aa, HIV-1
FWEVQLGIPHPAGLK

SEQ ID NO: 2149 - protein, 9 aa, HIV-1
VQLGIPHPA

SEQ ID NO: 2150 - protein, 15 aa, HIV-1
FYKTLRAEQASQEVK

SEQ ID NO: 2151 - protein, 9 aa, HIV-1
FYKTLRAEQ

SEQ ID NO: 2152 - protein, 15 aa, HIV-1
FYKTLRAEQASQEVK

SEQ ID NO: 2153 - protein, 9 aa, HIV-1
YKTLRAEQA

SEQ ID NO: 2154 - protein, 15 aa, HIV-1
FYVDGAANRETKLGK

SEQ ID NO: 2155 - protein, 9 aa, HIV-1
VDGAANRET

SEQ ID NO: 2156 - protein, 15 aa, HIV-1
GADDTVLEEMSLPGR

SEQ ID NO: 2157 - protein, 9 aa, HIV-1
VLEEMSLPG

SEQ ID NO: 2158 - protein, 15 aa, HIV-1
GAETFYVDGAANRET

SEQ ID NO: 2159 - protein, 9 aa, HIV-1
YVDGAANRE

SEQ ID NO: 2160 - protein, 15 aa, HIV-1
GATPQDLNTMLNTVG

SEQ ID NO: 2161 - protein, 9 aa, HIV-1
DLNTMLNTV

SEQ ID NO: 2162 - protein, 15 aa, HIV-1
GATPQDLNTMLNTVG

SEQ ID NO: 2163 - protein, 9 aa, HIV-1
PQDLNTMLN

SEQ ID NO: 2164 - protein, 15 aa, HIV-1
GATVRAACWWAGIKQ

SEQ ID NO: 2165 - protein, 9 aa, HIV-1
VRAACWWAG

SEQ ID NO: 2166 - protein, 15 aa, HIV-1
GCRQILGQLQPSLQT

SEQ ID NO: 2167 - protein, 9 aa, HIV-1
LGQLQPSLQ

SEQ ID NO: 2168 - protein, 15 aa, HIV-1
GCTLNFPISPIETVP

SEQ ID NO: 2169 - protein, 9 aa, HIV-1
FPISPIETV

SEQ ID NO: 2170 - protein, 15 aa, HIV-1
GDAYFSVPLDEDFRK

SEQ ID NO: 2171 - protein, 9 aa, HIV-1
YFSVPLDED

SEQ ID NO: 2172 - protein, 15 aa, HIV-1
GEIYKRWIILGLNKI

SEQ ID NO: 2173 - protein, 9 aa, HIV-1
IYKRWIILG

SEQ ID NO: 2174 - protein, 15 aa, HIV-1
GEIYKRWIILGLNKI

SEQ ID NO: 2175 - protein, 9 aa, HIV-1
YKRWIILGL

SEQ ID NO: 2176 - protein, 15 aa, HIV-1
GERIVDIIATDIQTK

SEQ ID NO: 2177 - protein, 9 aa, HIV-1
IVDIIATDI

SEQ ID NO: 2178 - protein, 15 aa, HIV-1
GGHQAAMQMLKETIN

SEQ ID NO: 2179 - protein, 9 aa, HIV-1
AAMQMLKET

SEQ ID NO: 2180 - protein, 15 aa, HIV-1
GHKAIGTVLVGPTPV

SEQ ID NO: 2181 - protein, 9 aa, HIV-1
HKAIGTVLV

SEQ ID NO: 2182 - protein, 15 aa, HIV-1
GHKAIGTVLVGPTPV

SEQ ID NO: 2183 - protein, 9 aa, HIV-1
IGTVLVGPT

SEQ ID NO: 2184 - protein, 15 aa, HIV-1
GHKARVLAEAMSQVT

SEQ ID NO: 2185 - protein, 9 aa, HIV-1
VLAEAMSQV

SEQ ID NO: 2186 - protein, 15 aa, HIV-1
GIIQAQPDQSESELV

SEQ ID NO: 2187 - protein, 9 aa, HIV-1
IIQAQPDQS

SEQ ID NO: 2188 - protein, 15 aa, HIV-1
GIIQAQPDQSESELV

SEQ ID NO: 2189 - protein, 9 aa, HIV-1
IQAQPDQSE

SEQ ID NO: 2190 - protein, 15 aa, HIV-1
GIKVRQLCKLLRGTK

SEQ ID NO: 2191 - protein, 9 aa, HIV-1
VRQLCKLLR

SEQ ID NO: 2192 - protein, 15 aa, HIV-1
GIPYNPQSQGVVESM

SEQ ID NO: 2193 - protein, 9 aa, HIV-1
PYNPQSQGV

SEQ ID NO: 2194 - protein, 15 aa, HIV-1
GIRYQYNVLPQGWKG

SEQ ID NO: 2195 - protein, 9 aa, HIV-1
IRYQYNVLP

SEQ ID NO: 2196 - protein, 15 aa, HIV-1
GIRYQYNVLPQGWKG

SEQ ID NO: 2197 - protein, 9 aa, HIV-1
YQYNVLPQG

SEQ ID NO: 2198 - protein, 15 aa, HIV-1
GKAGYVTNRGRQKVV

SEQ ID NO: 2199 - protein, 9 aa, HIV-1
VTNRGRQKV

SEQ ID NO: 2200 - protein, 15 aa, HIV-1
GKAGYVTNRGRQKVV

SEQ ID NO: 2201 - protein, 9 aa, HIV-1
YVTNRGRQK

SEQ ID NO: 2202 - protein, 15 aa, HIV-1
GKAREFSSEQTRANS

SEQ ID NO: 2203 - protein, 9 aa, HIV-1
FSSEQTRAN

SEQ ID NO: 2204 - protein, 15 aa, HIV-1
GKISKIGPENPYNTP

SEQ ID NO: 2205 - protein, 9 aa, HIV-1
IGPENPYNT

SEQ ID NO: 2206 - protein, 15 aa, HIV-1
GKKKYKLKHIVWASR

SEQ ID NO: 2207 - protein, 9 aa, HIV-1
YKLKHIVWA

SEQ ID NO: 2208 - protein, 15 aa, HIV-1
GKVILVAVHVASGYI

SEQ ID NO: 2209 - protein, 9 aa, HIV-1
LVAVHVASG

SEQ ID NO: 2210 - protein, 15 aa, HIV-1
GKVILVAVHVASGYI

SEQ ID NO: 2211 - protein, 9 aa, HIV-1
VILVAVHVA

SEQ ID NO: 2212 - protein, 15 aa, HIV-1
GKYARMRGAHTNDVK

SEQ ID NO: 2213 - protein, 9 aa, HIV-1
MRGAHTNDV

SEQ ID NO: 2214 - protein, 15 aa, HIV-1
GKYARMRGAHTNDVK

SEQ ID NO: 2215 - protein, 9 aa, HIV-1
YARMRGAHT

SEQ ID NO: 2216 - protein, 15 aa, HIV-1
GLEVNIVTDSQYALG

SEQ ID NO: 2217 - protein, 9 aa, HIV-1
VNIVTDSQY

SEQ ID NO: 2218 - protein, 15 aa, HIV-1
GLKKKKSVTVLDVGD

SEQ ID NO: 2219 - protein, 9 aa, HIV-1
LKKKKSVTV

SEQ ID NO: 2220 - protein, 15 aa, HIV-1
GLNKIVRMYSPTSIL

SEQ ID NO: 2221 - protein, 9 aa, HIV-1
IVRMYSPTS

SEQ ID NO: 2222 - protein, 15 aa, HIV-1
GLNKIVRMYSPTSIL

SEQ ID NO: 2223 - protein, 9 aa, HIV-1
LNKIVRMYS

SEQ ID NO: 2224 - protein, 15 aa, HIV-1
GLNKIVRMYSPTSIL

SEQ ID NO: 2225 - protein, 9 aa, HIV-1
VRMYSPTSI

SEQ ID NO: 2226 - protein, 15 aa, HIV-1
GMDGPKVKQWPLTEE

SEQ ID NO: 2227 - protein, 9 aa, HIV-1
KVKQWPLTE

SEQ ID NO: 2228 - protein, 15 aa, HIV-1
GNEQVDKLVSAGIRK

SEQ ID NO: 2229 - protein, 9 aa, HIV-1
VDKLVSAGI

SEQ ID NO: 2230 - protein, 15 aa, HIV-1
GNFRNQRKIVKCFNC

SEQ ID NO: 2231 - protein, 9 aa, HIV-1
FRNQRKIVK

SEQ ID NO: 2232 - protein, 15 aa, HIV-1
GPAKLLWKGEGAVVI

SEQ ID NO: 2233 - protein, 9 aa, HIV-1
LWKGEGAVV

SEQ ID NO: 2234 - protein, 15 aa, HIV-1
GPKVKQWPLTEEKIK

SEQ ID NO: 2235 - protein, 9 aa, HIV-1
VKQWPLTEE

SEQ ID NO: 2236 - protein, 15 aa, HIV-1
GPTPVNIIGRNLLTQ

SEQ ID NO: 2237 - protein, 9 aa, HIV-1
VNIIGRNLL

SEQ ID NO: 2238 - protein, 15 aa, HIV-1
GPAATLEEMMTACQG

SEQ ID NO: 2239 - protein, 9 aa, HIV-1
LEEMMTACQ

SEQ ID NO: 2240 - protein, 15 aa, HIV-1
GQETAYFLLKLAGRW

SEQ ID NO: 2241 - protein, 9 aa, HIV-1
YFLLKLAGR

SEQ ID NO: 2242 - protein, 15 aa, HIV-1
GQLQPSLQTGSEELR

SEQ ID NO: 2243 - protein, 9 aa, HIV-1
GQLQPSLQT

SEQ ID NO: 2244 - protein, 15 aa, HIV-1
GQMVHQAISPRTLNA

SEQ ID NO: 2245 - protein, 9 aa, HIV-1
MVHQAISPR

SEQ ID NO: 2246 - protein, 15 aa, HIV-1
GQMVHQAISPRTLNA

SEQ ID NO: 2247 - protein, 9 aa, HIV-1
VHQAISPRT

SEQ ID NO: 2248 - protein, 15 aa, HIV-1
GRNLLTQIGCTLNFP

SEQ ID NO: 2249 - protein, 9 aa, HIV-1
GRNLLTQIG

SEQ ID NO: 2250 - protein, 15 aa, HIV-1
GRQKVVTLTDTTNQK

SEQ ID NO: 2251 - protein, 9 aa, HIV-1
VTLTDTTNQ

SEQ ID NO: 2252 - protein, 15 aa, HIV-1
GRQKVVTLTDTTNQK

SEQ ID NO: 2253 - protein, 9 aa, HIV-1
VVTLTDTTN

SEQ ID NO: 2254 - protein, 15 aa, HIV-1
GRWPVKTIHTDNGSN

SEQ ID NO: 2255 - protein, 9 aa, HIV-1
VKTIHTDNG

SEQ ID NO: 2256 - protein, 15 aa, HIV-1
GSDIAGTTSTLQEQI

SEQ ID NO: 2257 - protein, 9 aa, HIV-1
IAGTTSTLQ

SEQ ID NO: 2258 - protein, 15 aa, HIV-1
GSEELRSLYNTVATL

SEQ ID NO: 2259 - protein, 9 aa, HIV-1
LRSLYNTVA

SEQ ID NO: 2260 - protein, 15 aa, HIV-1
GSNFTGATVRAACWW

SEQ ID NO: 2261 - protein, 9 aa, HIV-1
FTGATVRAA

SEQ ID NO: 2262 - protein, 15 aa, HIV-1
GSPAIFQSSMTKILE

SEQ ID NO: 2263 - protein, 9 aa, HIV-1
FQSSMTKIL

SEQ ID NO: 2264 - protein, 15 aa, HIV-1
GTTSTLQEQIGWMTN

SEQ ID NO: 2265 - protein, 9 aa, HIV-1
LQEQIGWMT

SEQ ID NO: 2266 - protein, 15 aa, HIV-1
GTVLVGPTPVNIIGR

SEQ ID NO: 2267 - protein, 9 aa, HIV-1
LVGPTPVNI

SEQ ID NO: 2268 - protein, 15 aa, HIV-1
GTVSFNFPQVTLWQR

SEQ ID NO: 2269 - protein, 9 aa, HIV-1
VSFNFPQVT

SEQ ID NO: 2270 - protein, 15 aa, HIV-1
GWKGSPAIFQSSMTK

SEQ ID NO: 2271 - protein, 9 aa, HIV-1
WKGSPAIFQ

SEQ ID NO: 2272 - protein, 15 aa, HIV-1
GWMTNNPPIPVGEIY

SEQ ID NO: 2273 - protein, 9 aa, HIV-1
MTNNPPIPV

SEQ ID NO: 2274 - protein, 15 aa, HIV-1
GYVTNRGRQKVVTLT

SEQ ID NO: 2275 - protein, 9 aa, HIV-1
VTNRGRQKV

SEQ ID NO: 2276 - protein, 15 aa, HIV-1
HEKYHSNWRAMASDF

SEQ ID NO: 2277 - protein, 9 aa, HIV-1
HSNWRAMAS

SEQ ID NO: 2278 - protein, 15 aa, HIV-1
HEKYHSNWRAMASDF

SEQ ID NO: 2279 - protein, 9 aa, HIV-1
YHSNWRAMA

SEQ ID NO: 2280 - protein, 15 aa, HIV-1
HKAIGTVLVGPTPVN

SEQ ID NO: 2281 - protein, 9 aa, HIV-1
HKAIGTVLV

SEQ ID NO: 2282 - protein, 15 aa, HIV-1
HKAIGTVLVGPTPVN

SEQ ID NO: 2283 - protein, 9 aa, HIV-1
IGTVLVGPT

SEQ ID NO: 2284 - protein, 15 aa, HIV-1
HKARVLAEAMSQVTN

SEQ ID NO: 2285 - protein, 9 aa, HIV-1
LAEAMSQVT

SEQ ID NO: 2286 - protein, 15 aa, HIV-1
HLEGKVILVAVHVAS

SEQ ID NO: 2287 - protein, 9 aa, HIV-1
VILVAVHVA

SEQ ID NO: 2288 - protein, 15 aa, HIV-1
HLKTAVQMAVFIHNF

SEQ ID NO: 2289 - protein, 9 aa, HIV-1
LKTAVQMAV

SEQ ID NO: 2290 - protein, 15 aa, HIV-1
HLLRWGLTTPDKKHQ

SEQ ID NO: 2291 - protein, 9 aa, HIV-1
LLRWGLTTP

SEQ ID NO: 2292 - protein, 15 aa, HIV-1
HLLRWGLTTPDKKHQ

SEQ ID NO: 2293 - protein, 9 aa, HIV-1
LRWGLTTPD

SEQ ID NO: 2294 - protein, 15 aa, HIV-1
HLLRWGLTTPDKKHQ

SEQ ID NO: 2295 - protein, 9 aa, HIV-1
WGLTTPDKK

SEQ ID NO: 2296 - protein, 15 aa, HIV-1
HNFKRKGGIGGYSAG

SEQ ID NO: 2297 - protein, 9 aa, HIV-1
FKRKGGIGG

SEQ ID NO: 2298 - protein, 15 aa, HIV-1
HPAGLKKKKSVTVLD

SEQ ID NO: 2299 - protein, 9 aa, HIV-1
LKKKKSVTV

SEQ ID NO: 2300 - protein, 15 aa, HIV-1
HPDKWTVQPIVLPEK

SEQ ID NO: 2301 - protein, 9 aa, HIV-1
WTVQPIVLP

SEQ ID NO: 2302 - protein, 15 aa, HIV-1
HPVHAGPIAPGQMRE

SEQ ID NO: 2303 - protein, 9 aa, HIV-1
VHAGPIAPG

SEQ ID NO: 2304 - protein, 15 aa, HIV-1
HQKEPPFLWMGYELH

SEQ ID NO: 2305 - protein, 9 aa, HIV-1
KEPPFLWMG

SEQ ID NO: 2306 - protein, 15 aa, HIV-1
HQKEPPFLWMGYELH

SEQ ID NO: 2307 - protein, 9 aa, HIV-1
QKEPPFLWM

SEQ ID NO: 2308 - protein, 15 aa, HIV-1
HSNWRAMASDFNLPP

SEQ ID NO: 2309 - protein, 9 aa, HIV-1
WRAMASDFN

SEQ ID NO: 2310 - protein, 15 aa, HIV-1
IAGTTSTLQEQIGWM

SEQ ID NO: 2311 - protein, 9 aa, HIV-1
IAGTTSTLQ

SEQ ID NO: 2312 - protein, 15 aa, HIV-1
IATDIQTKELQKQIT

SEQ ID NO: 2313 - protein, 9 aa, HIV-1
IQTKELQKQ

SEQ ID NO: 2314 - protein, 15 aa, HIV-1
ICGHKAIGTVLVGPT

SEQ ID NO: 2315 - protein, 9 aa, HIV-1
HKAIGTVLV

SEQ ID NO: 2316 - protein, 15 aa, HIV-1
IEAEVIPAETGQETA

SEQ ID NO: 2317 - protein, 9 aa, HIV-1
IPAETGQET

SEQ ID NO: 2318 - protein, 15 aa, HIV-1
IEELRQHLLRWGLTT

SEQ ID NO: 2319 - protein, 9 aa, HIV-1
LRQHLLRWG

SEQ ID NO: 2320 - protein, 15 aa, HIV-1
IEICGHKAIGTVLVG

SEQ ID NO: 2321 - protein, 9 aa, HIV-1
ICGHKAIGT

SEQ ID NO: 2322 - protein, 15 aa, HIV-1
IEQLIKKEKVYLAWV

SEQ ID NO: 2323 - protein, 9 aa, HIV-1
IKKEKVYLA

SEQ ID NO: 2324 - protein, 15 aa, HIV-1
IETVPVKLKPGMDGP

SEQ ID NO: 2325 - protein, 9 aa, HIV-1
VKLKPGMDG

SEQ ID NO: 2326 - protein, 15 aa, HIV-1
IFQSSMTKILEPFRK

SEQ ID NO: 2327 - protein, 9 aa, HIV-1
FQSSMTKIL

SEQ ID NO: 2328 - protein, 15 aa, HIV-1
IFQSSMTKILEPFRK

SEQ ID NO: 2329 - protein, 9 aa, HIV-1
MTKILEPFR

SEQ ID NO: 2330 - protein, 15 aa, HIV-1
IGCTLNFPISPIETV

SEQ ID NO: 2331 - protein, 9 aa, HIV-1
NFPISPIET

SEQ ID NO: 2332 - protein, 15 aa, HIV-1
IGPENPYNTPVFAIK

SEQ ID NO: 2333 - protein, 9 aa, HIV-1
IGPENPYNT

SEQ ID NO: 2334 - protein, 15 aa, HIV-1
IGRNLLTQIGCTLNF

SEQ ID NO: 2335 - protein, 9 aa, HIV-1
GRNLLTQIG

SEQ ID NO: 2336 - protein, 15 aa, HIV-1
IGRNLLTQIGCTLNF

SEQ ID NO: 2337 - protein, 9 aa, HIV-1
IGRNLLTQI

SEQ ID NO: 2338 - protein, 15 aa, HIV-1
IGTVLVGPTPVNIIG

SEQ ID NO: 2339 - protein, 9 aa, HIV-1
IGTVLVGPT

SEQ ID NO: 2340 - protein, 15 aa, HIV-1
IGTVLVGPTPVNIIG

SEQ ID NO: 2341 - protein, 9 aa, HIV-1
LVGPTPVNI

SEQ ID NO: 2342 - protein, 15 aa, HIV-1
IGTVLVGPTPVNIIG

SEQ ID NO: 2343 - protein, 9 aa, HIV-1
VLVGPTPVN

SEQ ID NO: 2344 - protein, 15 aa, HIV-1
IGWMTNNPPIPVGEI

SEQ ID NO: 2345 - protein, 9 aa, HIV-1
IGWMTNNPP

SEQ ID NO: 2346 - protein, 15 aa, HIV-1
IGWMTNNPPIPVGEI

SEQ ID NO: 2347 - protein, 9 aa, HIV-1
MTNNPPIPV

SEQ ID NO: 2348 - protein, 15 aa, HIV-1
IGWMTNNPPIPVGEI

SEQ ID NO: 2349 - protein, 9 aa, HIV-1
WMTNNPPIP

SEQ ID NO: 2350 - protein, 15 aa, HIV-1
IHNFKRKGGIGGYSA

SEQ ID NO: 2351 - protein, 9 aa, HIV-1
FKRKGGIGG

SEQ ID NO: 2352 - protein, 15 aa, HIV-1
IIATDIQTKELQKQI

SEQ ID NO: 2353 - protein, 9 aa, HIV-1
IQTKELQKQ

SEQ ID NO: 2354 - protein, 15 aa, HIV-1
IIEQLIKKEKVYLAW

SEQ ID NO: 2355 - protein, 9 aa, HIV-1
IKKEKVYLA

SEQ ID NO: 2356 - protein, 15 aa, HIV-1
IIGRNLLTQIGCTLN

SEQ ID NO: 2357 - protein, 9 aa, HIV-1
GRNLLTQIG

SEQ ID NO: 2358 - protein, 15 aa, HIV-1
IIGRNLLTQIGCTLN

SEQ ID NO: 2359 - protein, 9 aa, HIV-1
IGRNLLTQI

SEQ ID NO: 2360 - protein, 15 aa, HIV-1
IILGLNKIVRMYSPT

SEQ ID NO: 2361 - protein, 9 aa, HIV-1
ILGLNKIVR

SEQ ID NO: 2362 - protein, 15 aa, HIV-1
IILGLNKIVRMYSPT

SEQ ID NO: 2363 - protein, 9 aa, HIV-1
LGLNKIVRM

SEQ ID NO: 2364 - protein, 15 aa, HIV-1
IILGLNKIVRMYSPT

SEQ ID NO: 2365 - protein, 9 aa, HIV-1
LNKIVRMYS

SEQ ID NO: 2366 - protein, 15 aa, HIV-1
IIQAQPDQSESELVN

SEQ ID NO: 2367 - protein, 9 aa, HIV-1
IIQAQPDQS

SEQ ID NO: 2368 - protein, 15 aa, HIV-1
IKKEKVYLAWVPAHK

SEQ ID NO: 2369 - protein, 9 aa, HIV-1
IKKEKVYLA

SEQ ID NO: 2370 - protein, 15 aa, HIV-1
IKKEKVYLAWVPAHK

SEQ ID NO: 2371 - protein, 9 aa, HIV-1
VYLAWVPAH

SEQ ID NO: 2372 - protein, 15 aa, HIV-1
IKVRQLCKLLRGTKA

SEQ ID NO: 2373 - protein, 9 aa, HIV-1
VRQLCKLLR

SEQ ID NO: 2374 - protein, 15 aa, HIV-1
IKVVPRRKAKIIRDY

SEQ ID NO: 2375 - protein, 9 aa, HIV-1
IKVVPRRKA

SEQ ID NO: 2376 - protein, 15 aa, HIV-1
ILEPFRKQNPDIVIY

SEQ ID NO: 2377 - protein, 9 aa, HIV-1
FRKQNPDIV

SEQ ID NO: 2378 - protein, 15 aa, HIV-1
ILGLNKIVRMYSPTS

SEQ ID NO: 2379 - protein, 9 aa, HIV-1
ILGLNKIVR

SEQ ID NO: 2380 - protein, 15 aa, HIV-1
ILGLNKIVRMYSPTS

SEQ ID NO: 2381 - protein, 9 aa, HIV-1
LGLNKIVRM

SEQ ID NO: 2382 - protein, 15 aa, HIV-1
ILGLNKIVRMYSPTS

SEQ ID NO: 2383 - protein, 9 aa, HIV-1
LNKIVRMYS

SEQ ID NO: 2384 - protein, 15 aa, HIV-1
ILGQLQPSLQTGSEE

SEQ ID NO: 2385 - protein, 9 aa, HIV-1
GQLQPSLQT

SEQ ID NO: 2386 - protein, 15 aa, HIV-1
ILGQLQPSLQTGSEE

SEQ ID NO: 2387 - protein, 9 aa, HIV-1
LGQLQPSLQ

SEQ ID NO: 2388 - protein, 15 aa, HIV-1
ILIEICGHKAIGTVL

SEQ ID NO: 2389 - protein, 9 aa, HIV-1
ICGHKAIGT

SEQ ID NO: 2390 - protein, 15 aa, HIV-1
ILKALGPAATLEEMM

SEQ ID NO: 2391 - protein, 9 aa, HIV-1
LKALGPAAT

SEQ ID NO: 2392 - protein, 15 aa, HIV-1
ILVAVHVASGYIEAE

SEQ ID NO: 2393 - protein, 9 aa, HIV-1
LVAVHVASG

SEQ ID NO: 2394 - protein, 15 aa, HIV-1
IMMQRGNFRNQRKIV

SEQ ID NO: 2395 - protein, 9 aa, HIV-1
IMMQRGNFR

SEQ ID NO: 2396 - protein, 15 aa, HIV-1
INNETPGIRYQYNVL

SEQ ID NO: 2397 - protein, 9 aa, HIV-1
INNETPGIR

SEQ ID NO: 2398 - protein, 15 aa, HIV-1
IPEWEFVNTPPLVKL

SEQ ID NO: 2399 - protein, 9 aa, HIV-1
FVNTPPLVK

SEQ ID NO: 2400 - protein, 15 aa, HIV-1
IPEWEFVNTPPLVKL

SEQ ID NO: 2401 - protein, 9 aa, HIV-1
WEFVNTPPL

SEQ ID NO: 2402 - protein, 15 aa, HIV-1
IPHPAGLKKKKSVTV

SEQ ID NO: 2403 - protein, 9 aa, HIV-1
GLKKKKSVT

SEQ ID NO: 2404 - protein, 15 aa, HIV-1
IPHPAGLKKKKSVTV

SEQ ID NO: 2405 - protein, 9 aa, HIV-1
PAGLKKKKS

SEQ ID NO: 2406 - protein, 15 aa, HIV-1
IPMFSALSEGATPQD

SEQ ID NO: 2407 - protein, 9 aa, HIV-1
MFSALSEGA

SEQ ID NO: 2408 - protein, 15 aa, HIV-1
IPSINNETPGIRYQY

SEQ ID NO: 2409 - protein, 9 aa, HIV-1
INNETPGIR

SEQ ID NO: 2410 - protein, 15 aa, HIV-1
IPVGEIYKRWIILGL

SEQ ID NO: 2411 - protein, 9 aa, HIV-1
IYKRWIILG

SEQ ID NO: 2412 - protein, 15 aa, HIV-1
IQDNSDIKVVPRRKA

SEQ ID NO: 2413 - protein, 9 aa, HIV-1
IQDNSDIKV

SEQ ID NO: 2414 - protein, 15 aa, HIV-1
IQGQMVHQAISPRTL

SEQ ID NO: 2415 - protein, 9 aa, HIV-1
MVHQAISPR

SEQ ID NO: 2416 - protein, 15 aa, HIV-1
IQGQMVHQAISPRTL

SEQ ID NO: 2417 - protein, 9 aa, HIV-1
VHQAISPRT

SEQ ID NO: 2418 - protein, 15 aa, HIV-1
IQKETWETWWTEYWQ

SEQ ID NO: 2419 - protein, 9 aa, HIV-1
WETWWTEYW

SEQ ID NO: 2420 - protein, 15 aa, HIV-1
IQKLVGKLNWASQIY

SEQ ID NO: 2421 - protein, 9 aa, HIV-1
LVGKLNWAS

SEQ ID NO: 2422 - protein, 15 aa, HIV-1
IQKLVGKLNWASQIY

SEQ ID NO: 2423 - protein, 9 aa, HIV-1
VGKLNWASQ

SEQ ID NO: 2424 - protein, 15 aa, HIV-1
IQNFRVYYRDSRNPL

SEQ ID NO: 2425 - protein, 9 aa, HIV-1
IQNFRVYYR

SEQ ID NO: 2426 - protein, 15 aa, HIV-1
IQTKELQKQITKIQN

SEQ ID NO: 2427 - protein, 9 aa, HIV-1
LQKQITKIQ

SEQ ID NO: 2428 - protein, 15 aa, HIV-1
IRYQYNVLPQGWKGS

SEQ ID NO: 2429 - protein, 9 aa, HIV-1
IRYQYNVLP

SEQ ID NO: 2430 - protein, 15 aa, HIV-1
IRYQYNVLPQGWKGS

SEQ ID NO: 2431 - protein, 9 aa, HIV-1
YQYNVLPQG

SEQ ID NO: 2432 - protein, 15 aa, HIV-1
ISKIGPENPYNTPVF

SEQ ID NO: 2433 - protein, 9 aa, HIV-1
IGPENPYNT

SEQ ID NO: 2434 - protein, 15 aa, HIV-1
ISPIETVPVKLKPGM

SEQ ID NO: 2435 - protein, 9 aa, HIV-1
ISPIETVPV

SEQ ID NO: 2436 - protein, 15 aa, HIV-1
ISPRTLNAWVKVVEE

SEQ ID NO: 2437 - protein, 9 aa, HIV-1
LNAWVKVVE

SEQ ID NO: 2438 - protein, 15 aa, HIV-1
ISPRTLNAWVKVVEE

SEQ ID NO: 2439 - protein, 9 aa, HIV-1
TLNAWVKVV

SEQ ID NO: 2440 - protein, 15 aa, HIV-1
ITKIQNFRVYYRDSR

SEQ ID NO: 2441 - protein, 9 aa, HIV-1
IQNFRVYYR

SEQ ID NO: 2442 - protein, 15 aa, HIV-1
ITKIQNFRVYYRDSR

SEQ ID NO: 2443 - protein, 9 aa, HIV-1
ITKIQNFRV

SEQ ID NO: 2444 - protein, 15 aa, HIV-1
ITTESIVIWGKTPKF

SEQ ID NO: 2445 - protein, 9 aa, HIV-1
ITTESIVIW

SEQ ID NO: 2446 - protein, 15 aa, HIV-1
ITTESIVIWGKTPKF

SEQ ID NO: 2447 - protein, 9 aa, HIV-1
IVIWGKTPK

SEQ ID NO: 2448 - protein, 15 aa, HIV-1
IVGAETFYVDGAANR

SEQ ID NO: 2449 - protein, 9 aa, HIV-1
IVGAETFYV

SEQ ID NO: 2450 - protein, 15 aa, HIV-1
IVIWGKTPKFKLPIQ

SEQ ID NO: 2451 - protein, 9 aa, HIV-1
IVIWGKTPK

SEQ ID NO: 2452 - protein, 15 aa, HIV-1
IVIWGKTPKFKLPIQ

SEQ ID NO: 2453 - protein, 9 aa, HIV-1
IWGKTPKFK

SEQ ID NO: 2454 - protein, 15 aa, HIV-1
IVIWGKTPKFKLPIQ

SEQ ID NO: 2455 - protein, 9 aa, HIV-1
VIWGKTPKF

SEQ ID NO: 2456 - protein, 15 aa, HIV-1
IVIYQYMDDLYVGSD

SEQ ID NO: 2457 - protein, 9 aa, HIV-1
YQYMDDLYV

SEQ ID NO: 2458 - protein, 15 aa, HIV-1
IVQNIQGQMVHQAIS

SEQ ID NO: 2459 - protein, 9 aa, HIV-1
IQGQMVHQA

SEQ ID NO: 2460 - protein, 15 aa, HIV-1
IVRMYSPTSILDIRQ

SEQ ID NO: 2461 - protein, 9 aa, HIV-1
IVRMYSPTS

SEQ ID NO: 2462 - protein, 15 aa, HIV-1
IVRMYSPTSILDIRQ

SEQ ID NO: 2463 - protein, 9 aa, HIV-1
VRMYSPTSI

SEQ ID NO: 2464 - protein, 15 aa, HIV-1
IVRMYSPTSILDIRQ

SEQ ID NO: 2465 - protein, 9 aa, HIV-1
YSPTSILDI

SEQ ID NO: 2466 - protein, 15 aa, HIV-1
IVTDSQYALGIIQAQ

SEQ ID NO: 2467 - protein, 9 aa, HIV-1
QYALGIIQA

SEQ ID NO: 2468 - protein, 15 aa, HIV-1
IYKRWIILGLNKIVR

SEQ ID NO: 2469 - protein, 9 aa, HIV-1
WIILGLNKI

SEQ ID NO: 2470 - protein, 15 aa, HIV-1
IYKRWIILGLNKIVR

SEQ ID NO: 2471 - protein, 9 aa, HIV-1
YKRWIILGL

SEQ ID NO: 2472 - protein, 15 aa, HIV-1
IYLALQDSGLEVNIV

SEQ ID NO: 2473 - protein, 9 aa, HIV-1
LQDSGLEVN

SEQ ID NO: 2474 - protein, 15 aa, HIV-1
IYPGIKVRQLCKLLR

SEQ ID NO: 2475 - protein, 9 aa, HIV-1
IKVRQLCKL

SEQ ID NO: 2476 - protein, 15 aa, HIV-1
IYPGIKVRQLCKLLR

SEQ ID NO: 2477 - protein, 9 aa, HIV-1
YPGIKVRQL

SEQ ID NO: 2478 - protein, 15 aa, HIV-1
IYQEPFKNLKTGKYA

SEQ ID NO: 2479 - protein, 9 aa, HIV-1
FKNLKTGKY

SEQ ID NO: 2480 - protein, 15 aa, HIV-1
KAFSPEVIPMFSALS

SEQ ID NO: 2481 - protein, 9 aa, HIV-1
EVIPMFSAL

SEQ ID NO: 2482 - protein, 15 aa, HIV-1
KAFSPEVIPMFSALS

SEQ ID NO: 2483 - protein, 9 aa, HIV-1
FSPEVIPMF

SEQ ID NO: 2484 - protein, 15 aa, HIV-1
KAFSPEVIPMFSALS

SEQ ID NO: 2485 - protein, 9 aa, HIV-1
KAFSPEVIP

SEQ ID NO: 2486 - protein, 15 aa, HIV-1
KAGYVTNRGRQKVVT

SEQ ID NO: 2487 - protein, 9 aa, HIV-1
VTNRGRQKV

SEQ ID NO: 2488 - protein, 15 aa, HIV-1
KAGYVTNRGRQKVVT

SEQ ID NO: 2489 - protein, 9 aa, HIV-1
YVTNRGRQK

SEQ ID NO: 2490 - protein, 15 aa, HIV-1
KAIGTVLVGPTPVNI

SEQ ID NO: 2491 - protein, 9 aa, HIV-1
IGTVLVGPT

SEQ ID NO: 2492 - protein, 15 aa, HIV-1
KAIGTVLVGPTPVNI

SEQ ID NO: 2493 - protein, 9 aa, HIV-1
VLVGPTPVN

SEQ ID NO: 2494 - protein, 15 aa, HIV-1
KALGPAATLEEMMTA

SEQ ID NO: 2495 - protein, 9 aa, HIV-1
LGPAATLEE

SEQ ID NO: 2496 - protein, 15 aa, HIV-1
KAREFSSEQTRANSP

SEQ ID NO: 2497 - protein, 9 aa, HIV-1
FSSEQTRAN

SEQ ID NO: 2498 - protein, 15 aa, HIV-1
KARVLAEAMSQVTNS

SEQ ID NO: 2499 - protein, 9 aa, HIV-1
LAEAMSQVT

SEQ ID NO: 2500 - protein, 15 aa, HIV-1
KCQLKGEAMHGQVDC

SEQ ID NO: 2501 - protein, 9 aa, HIV-1
LKGEAMHGQ

SEQ ID NO: 2502 - protein, 15 aa, HIV-1
KEKVYLAWVPAHKGI

SEQ ID NO: 2503 - protein, 9 aa, HIV-1
LAWVPAHKG

SEQ ID NO: 2504 - protein, 15 aa, HIV-1
KEKVYLAWVPAHKGI

SEQ ID NO: 2505 - protein, 9 aa, HIV-1
VYLAWVPAH

SEQ ID NO: 2506 - protein, 15 aa, HIV-1
KEKVYLAWVPAHKGI

SEQ ID NO: 2507 - protein, 9 aa, HIV-1
YLAWVPAHK

SEQ ID NO: 2508 - protein, 15 aa, HIV-1
KELKKIIGQVRDQAE

SEQ ID NO: 2509 - protein, 9 aa, HIV-1
LKKIIGQVR

SEQ ID NO: 2510 - protein, 15 aa, HIV-1
KELQKQITKIQNFRV

SEQ ID NO: 2511 - protein, 9 aa, HIV-1
LQKQITKIQ

SEQ ID NO: 2512 - protein, 15 aa, HIV-1
KEPIVGAETFYVDGA

SEQ ID NO: 2513 - protein, 9 aa, HIV-1
IVGAETFYV

SEQ ID NO: 2514 - protein, 15 aa, HIV-1
KEPPFLWMGYELHPD

SEQ ID NO: 2515 - protein, 9 aa, HIV-1
FLWMGYELH

SEQ ID NO: 2516 - protein, 15 aa, HIV-1
KETWETWWTEYWQAT

SEQ ID NO: 2517 - protein, 9 aa, HIV-1
WETWWTEYW

SEQ ID NO: 2518 - protein, 15 aa, HIV-1
KGSPAIFQSSMTKIL

SEQ ID NO: 2519 - protein, 9 aa, HIV-1
IFQSSMTKI

SEQ ID NO: 2520 - protein, 15 aa, HIV-1
KIEELRQHLLRWGLT

SEQ ID NO: 2521 - protein, 9 aa, HIV-1
LRQHLLRWG

SEQ ID NO: 2522 - protein, 15 aa, HIV-1
KIGPENPYNTPVFAI

SEQ ID NO: 2523 - protein, 9 aa, HIV-1
IGPENPYNT

SEQ ID NO: 2524 - protein, 15 aa, HIV-1
KILEPFRKQNPDIVI

SEQ ID NO: 2525 - protein, 9 aa, HIV-1
FRKQNPDIV

SEQ ID NO: 2526 - protein, 15 aa, HIV-1
KIQNFRVYYRDSRNP

SEQ ID NO: 2527 - protein, 9 aa, HIV-1
IQNFRVYYR

SEQ ID NO: 2528 - protein, 15 aa, HIV-1
KISKIGPENPYNTPV

SEQ ID NO: 2529 - protein, 9 aa, HIV-1
IGPENPYNT

SEQ ID NO: 2530 - protein, 15 aa, HIV-1
KITTESIVIWGKTPK

SEQ ID NO: 2531 - protein, 9 aa, HIV-1
ESIVIWGKT

SEQ ID NO: 2532 - protein, 15 aa, HIV-1
KITTESIVIWGKTPK

SEQ ID NO: 2533 - protein, 9 aa, HIV-1
SIVIWGKTP

SEQ ID NO: 2534 - protein, 15 aa, HIV-1
KIVRMYSPTSILDIR

SEQ ID NO: 2535 - protein, 9 aa, HIV-1
IVRMYSPTS

SEQ ID NO: 2536 - protein, 15 aa, HIV-1
KIVRMYSPTSILDIR

SEQ ID NO: 2537 - protein, 9 aa, HIV-1
VRMYSPTSI

SEQ ID NO: 2538 - protein, 15 aa, HIV-1
KIVRMYSPTSILDIR

SEQ ID NO: 2539 - protein, 9 aa, HIV-1
YSPTSILDI

SEQ ID NO: 2540 - protein, 15 aa, HIV-1
KKEKVYLAWVPAHKG

SEQ ID NO: 2541 - protein, 9 aa, HIV-1
KVYLAWVPA

SEQ ID NO: 2542 - protein, 15 aa, HIV-1
KKEKVYLAWVPAHKG

SEQ ID NO: 2543 - protein, 9 aa, HIV-1
VYLAWVPAH

SEQ ID NO: 2544 - protein, 15 aa, HIV-1
KKEKVYLAWVPAHKG

SEQ ID NO: 2545 - protein, 9 aa, HIV-1
YLAWVPAHK

SEQ ID NO: 2546 - protein, 15 aa, HIV-1
KKKYKLKHIVWASRE

SEQ ID NO: 2547 - protein, 9 aa, HIV-1
LKHIVWASR

SEQ ID NO: 2548 - protein, 15 aa, HIV-1
KKKYKLKHIVWASRE

SEQ ID NO: 2549 - protein, 9 aa, HIV-1
YKLKHIVWA

SEQ ID NO: 2550 - protein, 15 aa, HIV-1
KKSVTVLDVGDAYFS

SEQ ID NO: 2551 - protein, 9 aa, HIV-1
VTVLDVGDA

SEQ ID NO: 2552 - protein, 15 aa, HIV-1
KKYKLKHIVWASREL

SEQ ID NO: 2553 - protein, 9 aa, HIV-1
LKHIVWASR

SEQ ID NO: 2554 - protein, 15 aa, HIV-1
KKYKLKHIVWASREL

SEQ ID NO: 2555 - protein, 9 aa, HIV-1
YKLKHIVWA

SEQ ID NO: 2556 - protein, 15 aa, HIV-1
KLAGRWPVKTIHTDN

SEQ ID NO: 2557 - protein, 9 aa, HIV-1
LAGRWPVKT

SEQ ID NO: 2558 - protein, 15 aa, HIV-1
KLGKAGYVTNRGRQK

SEQ ID NO: 2559 - protein, 9 aa, HIV-1
GYVTNRGRQ

SEQ ID NO: 2560 - protein, 15 aa, HIV-1
KLGKAGYVTNRGRQK

SEQ ID NO: 2561 - protein, 9 aa, HIV-1
KAGYVTNRG

SEQ ID NO: 2562 - protein, 15 aa, HIV-1
KLKHIVWASRELERF

SEQ ID NO: 2563 - protein, 9 aa, HIV-1
LKHIVWASR

SEQ ID NO: 2564 - protein, 15 aa, HIV-1
KLLRGTKALTEVIPL

SEQ ID NO: 2565 - protein, 9 aa, HIV-1
LRGTKALTE

SEQ ID NO: 2566 - protein, 15 aa, HIV-1
KLLWKGEGAVVIQDN

SEQ ID NO: 2567 - protein, 9 aa, HIV-1
WKGEGAVVI

SEQ ID NO: 2568 - protein, 15 aa, HIV-1
KLVDFRELNKRTQDF

SEQ ID NO: 2569 - protein, 9 aa, HIV-1
FRELNKRTQ

SEQ ID NO: 2570 - protein, 15 aa, HIV-1
KLVDFRELNKRTQDF

SEQ ID NO: 2571 - protein, 9 aa, HIV-1
VDFRELNKR

SEQ ID NO: 2572 - protein, 15 aa, HIV-1
KLVGKLNWASQIYPG

SEQ ID NO: 2573 - protein, 9 aa, HIV-1
KLNWASQIY

SEQ ID NO: 2574 - protein, 15 aa, HIV-1
KLVGKLNWASQIYPG

SEQ ID NO: 2575 - protein, 9 aa, HIV-1
LVGKLNWAS

SEQ ID NO: 2576 - protein, 15 aa, HIV-1
KLVSAGIRKVLFLDG

SEQ ID NO: 2577 - protein, 9 aa, HIV-1
LVSAGIRKV

SEQ ID NO: 2578 - protein, 15 aa, HIV-1
KNLKTGKYARMRGAH

SEQ ID NO: 2579 - protein, 9 aa, HIV-1
LKTGKYARM

SEQ ID NO: 2580 - protein, 15 aa, HIV-1
KNWMTETLLVQNANP

SEQ ID NO: 2581 - protein, 9 aa, HIV-1
WMTETLLVQ

SEQ ID NO: 2582 - protein, 15 aa, HIV-1
KQEFGIPYNPQSQGV

SEQ ID NO: 2583 - protein, 9 aa, HIV-1
FGIPYNPQS

SEQ ID NO: 2584 - protein, 15 aa, HIV-1
KQITKIQNFRVYYRD

SEQ ID NO: 2585 - protein, 9 aa, HIV-1
IQNFRVYYR

SEQ ID NO: 2586 - protein, 15 aa, HIV-1
KQITKIQNFRVYYRD

SEQ ID NO: 2587 - protein, 9 aa, HIV-1
ITKIQNFRV

SEQ ID NO: 2588 - protein, 15 aa, HIV-1
KQLTEAVQKITTESI

SEQ ID NO: 2589 - protein, 9 aa, HIV-1
AVQKITTES

SEQ ID NO: 2590 - protein, 15 aa, HIV-1
KRWIILGLNKIVRMY

SEQ ID NO: 2591 - protein, 9 aa, HIV-1
ILGLNKIVR

SEQ ID NO: 2592 - protein, 15 aa, HIV-1
KRWIILGLNKIVRMY

SEQ ID NO: 2593 - protein, 9 aa, HIV-1
LGLNKIVRM

SEQ ID NO: 2594 - protein, 15 aa, HIV-1
KRWIILGLNKIVRMY

SEQ ID NO: 2595 - protein, 9 aa, HIV-1
WIILGLNKI

SEQ ID NO: 2596 - protein, 15 aa, HIV-1
KSVTVLDVGDAYFSV

SEQ ID NO: 2597 - protein, 9 aa, HIV-1
LDVGDAYFS

SEQ ID NO: 2598 - protein, 15 aa, HIV-1
KTAVQMAVFIHNFKR

SEQ ID NO: 2599 - protein, 9 aa, HIV-1
VQMAVFIHN

SEQ ID NO: 2600 - protein, 15 aa, HIV-1
KTELQAIYLALQDSG

SEQ ID NO: 2601 - protein, 9 aa, HIV-1
LQAIYLALQ

SEQ ID NO: 2602 - protein, 15 aa, HIV-1
KTGKYARMRGAHTND

SEQ ID NO: 2603 - protein, 9 aa, HIV-1
YARMRGAHT

SEQ ID NO: 2604 - protein, 15 aa, HIV-1
KTILKALGPAATLEE

SEQ ID NO: 2605 - protein, 9 aa, HIV-1
ILKALGPAA

SEQ ID NO: 2606 - protein, 15 aa, HIV-1
KTILKALGPAATLEE

SEQ ID NO: 2607 - protein, 9 aa, HIV-1
LKALGPAAT

SEQ ID NO: 2608 - protein, 15 aa, HIV-1
KVILVAVHVASGYIE

SEQ ID NO: 2609 - protein, 9 aa, HIV-1
LVAVHVASG

SEQ ID NO: 2610 - protein, 15 aa, HIV-1
KVILVAVHVASGYIE

SEQ ID NO: 2611 - protein, 9 aa, HIV-1
VILVAVHVA

SEQ ID NO: 2612 - protein, 15 aa, HIV-1
KVKQWPLTEEKIKAL

SEQ ID NO: 2613 - protein, 9 aa, HIV-1
VKQWPLTEE

SEQ ID NO: 2614 - protein, 15 aa, HIV-1
KVRQLCKLLRGTKAL

SEQ ID NO: 2615 - protein, 9 aa, HIV-1
VRQLCKLLR

SEQ ID NO: 2616 - protein, 15 aa, HIV-1
KVVTLTDTTNQKTEL

SEQ ID NO: 2617 - protein, 9 aa, HIV-1
VTLTDTTNQ

SEQ ID NO: 2618 - protein, 15 aa, HIV-1
KVYLAWVPAHKGIGG

SEQ ID NO: 2619 - protein, 9 aa, HIV-1
LAWVPAHKG

SEQ ID NO: 2620 - protein, 15 aa, HIV-1
KVYLAWVPAHKGIGG

SEQ ID NO: 2621 - protein, 9 aa, HIV-1
VYLAWVPAH

SEQ ID NO: 2622 - protein, 15 aa, HIV-1
KVYLAWVPAHKGIGG

SEQ ID NO: 2623 - protein, 9 aa, HIV-1
WVPAHKGIG

SEQ ID NO: 2624 - protein, 15 aa, HIV-1
KVYLAWVPAHKGIGG

SEQ ID NO: 2625 - protein, 9 aa, HIV-1
YLAWVPAHK

SEQ ID NO: 2626 - protein, 15 aa, HIV-1
KWRKLVDFRELNKRT

SEQ ID NO: 2627 - protein, 9 aa, HIV-1
VDFRELNKR

SEQ ID NO: 2628 - protein, 15 aa, HIV-1
KWTVQPIVLPEKDSW

SEQ ID NO: 2629 - protein, 9 aa, HIV-1
WTVQPIVLP

SEQ ID NO: 2630 - protein, 15 aa, HIV-1
KYARMRGAHTNDVKQ

SEQ ID NO: 2631 - protein, 9 aa, HIV-1
MRGAHTNDV

SEQ ID NO: 2632 - protein, 15 aa, HIV-1
KYHSNWRAMASDFNL

SEQ ID NO: 2633 - protein, 9 aa, HIV-1
WRAMASDFN

SEQ ID NO: 2634 - protein, 15 aa, HIV-1
KYHSNWRAMASDFNL

SEQ ID NO: 2635 - protein, 9 aa, HIV-1
YHSNWRAMA

SEQ ID NO: 2636 - protein, 15 aa, HIV-1
KYKLKHIVWASRELE

SEQ ID NO: 2637 - protein, 9 aa, HIV-1
LKHIVWASR

SEQ ID NO: 2638 - protein, 15 aa, HIV-1
LAEAMSQVTNSATIM

SEQ ID NO: 2639 - protein, 9 aa, HIV-1
AMSQVTNSA

SEQ ID NO: 2640 - protein, 15 aa, HIV-1
LAEAMSQVTNSATIM

SEQ ID NO: 2641 - protein, 9 aa, HIV-1
LAEAMSQVT

SEQ ID NO: 2642 - protein, 15 aa, HIV-1
LAENREILKEPVHGV

SEQ ID NO: 2643 - protein, 9 aa, HIV-1
EILKEPVHG

SEQ ID NO: 2644 - protein, 15 aa, HIV-1
LAFLQGKAREFSSEQ

SEQ ID NO: 2645 - protein, 9 aa, HIV-1
FLQGKAREF

SEQ ID NO: 2646 - protein, 15 aa, HIV-1
LAGRWPVKTIHTDNG

SEQ ID NO: 2647 - protein, 9 aa, HIV-1
LAGRWPVKT

SEQ ID NO: 2648 - protein, 15 aa, HIV-1
LAWVPAHKGIGGNEQ

SEQ ID NO: 2649 - protein, 9 aa, HIV-1
LAWVPAHKG

SEQ ID NO: 2650 - protein, 15 aa, HIV-1
LCKLLRGTKALTEVI

SEQ ID NO: 2651 - protein, 9 aa, HIV-1
LRGTKALTE

SEQ ID NO: 2652 - protein, 15 aa, HIV-1
LDEDFRKYTAFTIPS

SEQ ID NO: 2653 - protein, 9 aa, HIV-1
FRKYTAFTI

SEQ ID NO: 2654 - protein, 15 aa, HIV-1
LDVGDAYFSVPLDED

SEQ ID NO: 2655 - protein, 9 aa, HIV-1
DAYFSVPLD

SEQ ID NO: 2656 - protein, 15 aa, HIV-1
LEEMMTACQGVGGPG

SEQ ID NO: 2657 - protein, 9 aa, HIV-1
MTACQGVGG

SEQ ID NO: 2658 - protein, 15 aa, HIV-1
LEEMSLPGRWKPKMI

SEQ ID NO: 2659 - protein, 9 aa, HIV-1
LEEMSLPGR

SEQ ID NO: 2660 - protein, 15 aa, HIV-1
LEGKVILVAVHVASG

SEQ ID NO: 2661 - protein, 9 aa, HIV-1
KVILVAVHV

SEQ ID NO: 2662 - protein, 15 aa, HIV-1
LEGKVILVAVHVASG

SEQ ID NO: 2663 - protein, 9 aa, HIV-1
VILVAVHVA

SEQ ID NO: 2664 - protein, 15 aa, HIV-1
LEKEPIVGAETFYVD

SEQ ID NO: 2665 - protein, 9 aa, HIV-1
IVGAETFYV

SEQ ID NO: 2666 - protein, 15 aa, HIV-1
LEPFRKQNPDIVIYQ

SEQ ID NO: 2667 - protein, 9 aa, HIV-1
FRKQNPDIV

SEQ ID NO: 2668 - protein, 15 aa, HIV-1
LERFAVNPGLLETSE

SEQ ID NO: 2669 - protein, 9 aa, HIV-1
FAVNPGLLE

SEQ ID NO: 2670 - protein, 15 aa, HIV-1
LERFAVNPGLLETSE

SEQ ID NO: 2671 - protein, 9 aa, HIV-1
VNPGLLETS

SEQ ID NO: 2672 - protein, 15 aa, HIV-1
LEVNIVTDSQYALGI

SEQ ID NO: 2673 - protein, 9 aa, HIV-1
VNIVTDSQY

SEQ ID NO: 2674 - protein, 15 aa, HIV-1
LGIIQAQPDQSESEL

SEQ ID NO: 2675 - protein, 9 aa, HIV-1
IIQAQPDQS

SEQ ID NO: 2676 - protein, 15 aa, HIV-1
LGIIQAQPDQSESEL

SEQ ID NO: 2677 - protein, 9 aa, HIV-1
IQAQPDQSE

SEQ ID NO: 2678 - protein, 15 aa, HIV-1
LGKAGYVTNRGRQKV

SEQ ID NO: 2679 - protein, 9 aa, HIV-1
YVTNRGRQK

SEQ ID NO: 2680 - protein, 15 aa, HIV-1
LGLNKIVRMYSPTSI

SEQ ID NO: 2681 - protein, 9 aa, HIV-1
IVRMYSPTS

SEQ ID NO: 2682 - protein, 15 aa, HIV-1
LGLNKIVRMYSPTSI

SEQ ID NO: 2683 - protein, 9 aa, HIV-1
LGLNKIVRM

SEQ ID NO: 2684 - protein, 15 aa, HIV-1
LGLNKIVRMYSPTSI

SEQ ID NO: 2685 - protein, 9 aa, HIV-1
LNKIVRMYS

SEQ ID NO: 2686 - protein, 15 aa, HIV-1
LGPAATLEEMMTACQ

SEQ ID NO: 2687 - protein, 9 aa, HIV-1
AATLEEMMT

SEQ ID NO: 2688 - protein, 15 aa, HIV-1
LGQLQPSLQTGSEEL

SEQ ID NO: 2689 - protein, 9 aa, HIV-1
LGQLQPSLQ

SEQ ID NO: 2690 - protein, 15 aa, HIV-1
LHPDKWTVQPIVLPE

SEQ ID NO: 2691 - protein, 9 aa, HIV-1
WTVQPIVLP

SEQ ID NO: 2692 - protein, 15 aa, HIV-1
LIEICGHKAIGTVLV

SEQ ID NO: 2693 - protein, 9 aa, HIV-1
ICGHKAIGT

SEQ ID NO: 2694 - protein, 15 aa, HIV-1
LIKKEKVYLAWVPAH

SEQ ID NO: 2695 - protein, 9 aa, HIV-1
KVYLAWVPA

SEQ ID NO: 2696 - protein, 15 aa, HIV-1
LKALGPAATLEEMMT

SEQ ID NO: 2697 - protein, 9 aa, HIV-1
LKALGPAAT

SEQ ID NO: 2698 - protein, 15 aa, HIV-1
LKHIVWASRELERFA

SEQ ID NO: 2699 - protein, 9 aa, HIV-1
LKHIVWASR

SEQ ID NO: 2700 - protein, 15 aa, HIV-1
LKKKKSVTVLDVGDA

SEQ ID NO: 2701 - protein, 9 aa, HIV-1
LKKKKSVTV

SEQ ID NO: 2702 - protein, 15 aa, HIV-1
LKLAGRWPVKTIHTD

SEQ ID NO: 2703 - protein, 9 aa, HIV-1
LAGRWPVKT

SEQ ID NO: 2704 - protein, 15 aa, HIV-1
LKLAGRWPVKTIHTD

SEQ ID NO: 2705 - protein, 9 aa, HIV-1
LKLAGRWPV

SEQ ID NO: 2706 - protein, 15 aa, HIV-1
LKTAVQMAVFIHNFK

SEQ ID NO: 2707 - protein, 9 aa, HIV-1
LKTAVQMAV

SEQ ID NO: 2708 - protein, 15 aa, HIV-1
LKTAVQMAVFIHNFK

SEQ ID NO: 2709 - protein, 9 aa, HIV-1
VQMAVFIHN

SEQ ID NO: 2710 - protein, 15 aa, HIV-1
LKTGKYARMRGAHTN

SEQ ID NO: 2711 - protein, 9 aa, HIV-1
YARMRGAHT

SEQ ID NO: 2712 - protein, 15 aa, HIV-1
LLKLAGRWPVKTIHT

SEQ ID NO: 2713 - protein, 9 aa, HIV-1
LAGRWPVKT

SEQ ID NO: 2714 - protein, 15 aa, HIV-1
LLKLAGRWPVKTIHT

SEQ ID NO: 2715 - protein, 9 aa, HIV-1
LKLAGRWPV

SEQ ID NO: 2716 - protein, 15 aa, HIV-1
LLRWGLTTPDKKHQK

SEQ ID NO: 2717 - protein, 9 aa, HIV-1
LLRWGLTTP

SEQ ID NO: 2718 - protein, 15 aa, HIV-1
LLRWGLTTPDKKHQK

SEQ ID NO: 2719 - protein, 9 aa, HIV-1
LRWGLTTPD

SEQ ID NO: 2720 - protein, 15 aa, HIV-1
LLRWGLTTPDKKHQK

SEQ ID NO: 2721 - protein, 9 aa, HIV-1
WGLTTPDKK

SEQ ID NO: 2722 - protein, 15 aa, HIV-1
LLVQNANPDCKTILK

SEQ ID NO: 2723 - protein, 9 aa, HIV-1
VQNANPDCK

SEQ ID NO: 2724 - protein, 15 aa, HIV-1
LLWKGEGAVVIQDNS

SEQ ID NO: 2725 - protein, 9 aa, HIV-1
WKGEGAVVI

SEQ ID NO: 2726 - protein, 15 aa, HIV-1
LNFPISPIETVPVKL

SEQ ID NO: 2727 - protein, 9 aa, HIV-1
ISPIETVPV

SEQ ID NO: 2728 - protein, 15 aa, HIV-1
LNKIVRMYSPTSILD

SEQ ID NO: 2729 - protein, 9 aa, HIV-1
IVRMYSPTS

SEQ ID NO: 2730 - protein, 15 aa, HIV-1
LNKIVRMYSPTSILD

SEQ ID NO: 2731 - protein, 9 aa, HIV-1
LNKIVRMYS

SEQ ID NO: 2732 - protein, 15 aa, HIV-1
LNKIVRMYSPTSILD

SEQ ID NO: 2733 - protein, 9 aa, HIV-1
VRMYSPTSI

SEQ ID NO: 2734 - protein, 15 aa, HIV-1
LNTMLNTVGGHQAAM

SEQ ID NO: 2735 - protein, 9 aa, HIV-1
LNTMLNTVG

SEQ ID NO: 2736 - protein, 15 aa, HIV-1
LNTMLNTVGGHQAAM

SEQ ID NO: 2737 - protein, 9 aa, HIV-1
MLNTVGGHQ

SEQ ID NO: 2738 - protein, 15 aa, HIV-1
LNTVGGHQAAMQMLK

SEQ ID NO: 2739 - protein, 9 aa, HIV-1
VGGHQAAMQ

SEQ ID NO: 2740 - protein, 15 aa, HIV-1
LPPVVAKEIVASCDK

SEQ ID NO: 2741 - protein, 9 aa, HIV-1
VVAKEIVAS

SEQ ID NO: 2742 - protein, 15 aa, HIV-1
LPQGWKGSPAIFQSS

SEQ ID NO: 2743 - protein, 9 aa, HIV-1
WKGSPAIFQ

SEQ ID NO: 2744 - protein, 15 aa, HIV-1
LQAIYLALQDSGLEV

SEQ ID NO: 2745 - protein, 9 aa, HIV-1
LQAIYLALQ

SEQ ID NO: 2746 - protein, 15 aa, HIV-1
LQEQIGWMTNNPPIP

SEQ ID NO: 2747 - protein, 9 aa, HIV-1
IGWMTNNPP

SEQ ID NO: 2748 - protein, 15 aa, HIV-1
LQKQITKIQNFRVYY

SEQ ID NO: 2749 - protein, 9 aa, HIV-1
ITKIQNFRV

SEQ ID NO: 2750 - protein, 15 aa, HIV-1
LQKQITKIQNFRVYY

SEQ ID NO: 2751 - protein, 9 aa, HIV-1
LQKQITKIQ

SEQ ID NO: 2752 - protein, 15 aa, HIV-1
LREDLAFLQGKAREF

SEQ ID NO: 2753 - protein, 9 aa, HIV-1
LAFLQGKAR

SEQ ID NO: 2754 - protein, 15 aa, HIV-1
LRQHLLRWGLTTPDK

SEQ ID NO: 2755 - protein, 9 aa, HIV-1
LLRWGLTTP

SEQ ID NO: 2756 - protein, 15 aa, HIV-1
LRQHLLRWGLTTPDK

SEQ ID NO: 2757 - protein, 9 aa, HIV-1
LRWGLTTPD

SEQ ID NO: 2758 - protein, 15 aa, HIV-1
LRSLYNTVATLYCVH

SEQ ID NO: 2759 - protein, 9 aa, HIV-1
LYNTVATLY

SEQ ID NO: 2760 - protein, 15 aa, HIV-1
LRSLYNTVATLYCVH

SEQ ID NO: 2761 - protein, 9 aa, HIV-1
YNTVATLYC

SEQ ID NO: 2762 - protein, 15 aa, HIV-1
LRWGLTTPDKKHQKE

SEQ ID NO: 2763 - protein, 9 aa, HIV-1
LRWGLTTPD

SEQ ID NO: 2764 - protein, 15 aa, HIV-1
LRWGLTTPDKKHQKE

SEQ ID NO: 2765 - protein, 9 aa, HIV-1
WGLTTPDKK

SEQ ID NO: 2766 - protein, 15 aa, HIV-1
LTEAVQKITTESIVI

SEQ ID NO: 2767 - protein, 9 aa, HIV-1
VQKITTESI

SEQ ID NO: 2768 - protein, 15 aa, HIV-1
LTEEKIKALVEICTE

SEQ ID NO: 2769 - protein, 9 aa, HIV-1
IKALVEICT

SEQ ID NO: 2770 - protein, 15 aa, HIV-1
LVGKLNWASQIYPGI

SEQ ID NO: 2771 - protein, 9 aa, HIV-1
KLNWASQIY

SEQ ID NO: 2772 - protein, 15 aa, HIV-1
LVGKLNWASQIYPGI

SEQ ID NO: 2773 - protein, 9 aa, HIV-1
LVGKLNWAS

SEQ ID NO: 2774 - protein, 15 aa, HIV-1
LVGPTPVNIIGRNLL

SEQ ID NO: 2775 - protein, 9 aa, HIV-1
GPTPVNIIG

SEQ ID NO: 2776 - protein, 15 aa, HIV-1
LVGPTPVNIIGRNLL

SEQ ID NO: 2777 - protein, 9 aa, HIV-1
LVGPTPVNI

SEQ ID NO: 2778 - protein, 15 aa, HIV-1
LVKLWYQLEKEPIVG

SEQ ID NO: 2779 - protein, 9 aa, HIV-1
VKLWYQLEK

SEQ ID NO: 2780 - protein, 15 aa, HIV-1
LVSAGIRKVLFLDGI

SEQ ID NO: 2781 - protein, 9 aa, HIV-1
LVSAGIRKV

SEQ ID NO: 2782 - protein, 15 aa, HIV-1
LWKGEGAVVIQDNSD

SEQ ID NO: 2783 - protein, 9 aa, HIV-1
WKGEGAVVI

SEQ ID NO: 2784 - protein, 15 aa, HIV-1
LWKGPAKLLWKGEGA

SEQ ID NO: 2785 - protein, 9 aa, HIV-1
LWKGPAKLL

SEQ ID NO: 2786 - protein, 15 aa, HIV-1
LWQRPLVTIKIGGQL

SEQ ID NO: 2787 - protein, 9 aa, HIV-1
LWQRPLVTI

SEQ ID NO: 2788 - protein, 15 aa, HIV-1
LYNTVATLYCVHQRI

SEQ ID NO: 2789 - protein, 9 aa, HIV-1
LYNTVATLY

SEQ ID NO: 2790 - protein, 15 aa, HIV-1
LYNTVATLYCVHQRI

SEQ ID NO: 2791 - protein, 9 aa, HIV-1
YNTVATLYC

SEQ ID NO: 2792 - protein, 15 aa, HIV-1
MASDFNLPPVVAKEI

SEQ ID NO: 2793 - protein, 9 aa, HIV-1
DFNLPPVVA

SEQ ID NO: 2794 - protein, 15 aa, HIV-1
MASDFNLPPVVAKEI

SEQ ID NO: 2795 - protein, 9 aa, HIV-1
MASDFNLPP

SEQ ID NO: 2796 - protein, 15 aa, HIV-1
MAVFIHNFKRKGGIG

SEQ ID NO: 2797 - protein, 9 aa, HIV-1
FIHNFKRKG

SEQ ID NO: 2798 - protein, 15 aa, HIV-1
MAVFIHNFKRKGGIG

SEQ ID NO: 2799 - protein, 9 aa, HIV-1
IHNFKRKGG

SEQ ID NO: 2800 - protein, 15 aa, HIV-1
MDDLYVGSDLEIGQH

SEQ ID NO: 2801 - protein, 9 aa, HIV-1
YVGSDLEIG

SEQ ID NO: 2802 - protein, 15 aa, HIV-1
MDGPKVKQWPLTEEK

SEQ ID NO: 2803 - protein, 9 aa, HIV-1
VKQWPLTEE

SEQ ID NO: 2804 - protein, 15 aa, HIV-1
MFSALSEGATPQDLN

SEQ ID NO: 2805 - protein, 9 aa, HIV-1
MFSALSEGA

SEQ ID NO: 2806 - protein, 15 aa, HIV-1
MGARASVLSGGELDR

SEQ ID NO: 2807 - protein, 9 aa, HIV-1
MGARASVLS

SEQ ID NO: 2808 - protein, 15 aa, HIV-1
MLNTVGGHQAAMQML

SEQ ID NO: 2809 - protein, 9 aa, HIV-1
MLNTVGGHQ

SEQ ID NO: 2810 - protein, 15 aa, HIV-1
MLNTVGGHQAAMQML

SEQ ID NO: 2811 - protein, 9 aa, HIV-1
VGGHQAAMQ

SEQ ID NO: 2812 - protein, 15 aa, HIV-1
MMQRGNFRNQRKIVK

SEQ ID NO: 2813 - protein, 9 aa, HIV-1
NFRNQRKIV

SEQ ID NO: 2814 - protein, 15 aa, HIV-1
MMQRGNFRNQRKIVK

SEQ ID NO: 2815 - protein, 9 aa, HIV-1
QRGNFRNQR

SEQ ID NO: 2816 - protein, 15 aa, HIV-1
MMQRGNFRNQRKIVK

SEQ ID NO: 2817 - protein, 9 aa, HIV-1
RGNFRNQRK

SEQ ID NO: 2818 - protein, 15 aa, HIV-1
MNKELKKIIGQVRDQ

SEQ ID NO: 2819 - protein, 9 aa, HIV-1
LKKIIGQVR

SEQ ID NO: 2820 - protein, 15 aa, HIV-1
MQRGNFRNQRKIVKC

SEQ ID NO: 2821 - protein, 9 aa, HIV-1
FRNQRKIVK

SEQ ID NO: 2822 - protein, 15 aa, HIV-1
MRGAHTNDVKQLTEA

SEQ ID NO: 2823 - protein, 9 aa, HIV-1
MRGAHTNDV

SEQ ID NO: 2824 - protein, 15 aa, HIV-1
MSQVTNSATIMMQRG

SEQ ID NO: 2825 - protein, 9 aa, HIV-1
VTNSATIMM

SEQ ID NO: 2826 - protein, 15 aa, HIV-1
MTETLLVQNANPDCK

SEQ ID NO: 2827 - protein, 9 aa, HIV-1
LLVQNANPD

SEQ ID NO: 2828 - protein, 15 aa, HIV-1
MTETLLVQNANPDCK

SEQ ID NO: 2829 - protein, 9 aa, HIV-1
MTETLLVQN

SEQ ID NO: 2830 - protein, 15 aa, HIV-1
MTNNPPIPVGEIYKR

SEQ ID NO: 2831 - protein, 9 aa, HIV-1
MTNNPPIPV

SEQ ID NO: 2832 - protein, 15 aa, HIV-1
MVHQAISPRTLNAWV

SEQ ID NO: 2833 - protein, 9 aa, HIV-1
MVHQAISPR

SEQ ID NO: 2834 - protein, 15 aa, HIV-1
MVHQAISPRTLNAWV

SEQ ID NO: 2835 - protein, 9 aa, HIV-1
VHQAISPRT

SEQ ID NO: 2836 - protein, 15 aa, HIV-1
NDIQKLVGKLNWASQ

SEQ ID NO: 2837 - protein, 9 aa, HIV-1
LVGKLNWAS

SEQ ID NO: 2838 - protein, 15 aa, HIV-1
NEQVDKLVSAGIRKV

SEQ ID NO: 2839 - protein, 9 aa, HIV-1
VDKLVSAGI

SEQ ID NO: 2840 - protein, 15 aa, HIV-1
NETPGIRYQYNVLPQ

SEQ ID NO: 2841 - protein, 9 aa, HIV-1
IRYQYNVLP

SEQ ID NO: 2842 - protein, 15 aa, HIV-1
NFLREDLAFLQGKAR

SEQ ID NO: 2843 - protein, 9 aa, HIV-1
FLREDLAFL

SEQ ID NO: 2844 - protein, 15 aa, HIV-1
NFPISPIETVPVKLK

SEQ ID NO: 2845 - protein, 9 aa, HIV-1
ISPIETVPV

SEQ ID NO: 2846 - protein, 15 aa, HIV-1
NFPQVTLWQRPLVTI

SEQ ID NO: 2847 - protein, 9 aa, HIV-1
TLWQRPLVT

SEQ ID NO: 2848 - protein, 15 aa, HIV-1
NFRNQRKIVKCFNCG

SEQ ID NO: 2849 - protein, 9 aa, HIV-1
FRNQRKIVK

SEQ ID NO: 2850 - protein, 15 aa, HIV-1
NFRVYYRDSRNPLWK

SEQ ID NO: 2851 - protein, 9 aa, HIV-1
FRVYYRDSR

SEQ ID NO: 2852 - protein, 15 aa, HIV-1
NFRVYYRDSRNPLWK

SEQ ID NO: 2853 - protein, 9 aa, HIV-1
YRDSRNPLW

SEQ ID NO: 2854 - protein, 15 aa, HIV-1
NFRVYYRDSRNPLWK

SEQ ID NO: 2855 - protein, 9 aa, HIV-1
YYRDSRNPL

SEQ ID NO: 2856 - protein, 15 aa, HIV-1
NFTGATVRAACWWAG

SEQ ID NO: 2857 - protein, 9 aa, HIV-1
FTGATVRAA

SEQ ID NO: 2858 - protein, 15 aa, HIV-1
NGSNFTGATVRAACW

SEQ ID NO: 2859 - protein, 9 aa, HIV-1
FTGATVRAA

SEQ ID NO: 2860 - protein, 15 aa, HIV-1
NIIGRNLLTQIGCTL

SEQ ID NO: 2861 - protein, 9 aa, HIV-1
GRNLLTQIG

SEQ ID NO: 2862 - protein, 15 aa, HIV-1
NIIGRNLLTQIGCTL

SEQ ID NO: 2863 - protein, 9 aa, HIV-1
IGRNLLTQI

SEQ ID NO: 2864 - protein, 15 aa, HIV-1
NIQGQMVHQAISPRT

SEQ ID NO: 2865 - protein, 9 aa, HIV-1
IQGQMVHQA

SEQ ID NO: 2866 - protein, 15 aa, HIV-1
NIQGQMVHQAISPRT

SEQ ID NO: 2867 - protein, 9 aa, HIV-1
MVHQAISPR

SEQ ID NO: 2868 - protein, 15 aa, HIV-1
NKELKKIIGQVRDQA

SEQ ID NO: 2869 - protein, 9 aa, HIV-1
LKKIIGQVR

SEQ ID NO: 2870 - protein, 15 aa, HIV-1
NKIVRMYSPTSILDI

SEQ ID NO: 2871 - protein, 9 aa, HIV-1
IVRMYSPTS

SEQ ID NO: 2872 - protein, 15 aa, HIV-1
NKIVRMYSPTSILDI

SEQ ID NO: 2873 - protein, 9 aa, HIV-1
VRMYSPTSI

SEQ ID NO: 2874 - protein, 15 aa, HIV-1
NLKTGKYARMRGAHT

SEQ ID NO: 2875 - protein, 9 aa, HIV-1
GKYARMRGA

SEQ ID NO: 2876 - protein, 15 aa, HIV-1
NLKTGKYARMRGAHT

SEQ ID NO: 2877 - protein, 9 aa, HIV-1
LKTGKYARM

SEQ ID NO: 2878 - protein, 15 aa, HIV-1
NLKTGKYARMRGAHT

SEQ ID NO: 2879 - protein, 9 aa, HIV-1
NLKTGKYAR

SEQ ID NO: 2880 - protein, 15 aa, HIV-1
NLPPVVAKEIVASCD

SEQ ID NO: 2881 - protein, 9 aa, HIV-1
VVAKEIVAS

SEQ ID NO: 2882 - protein, 15 aa, HIV-1
NNETPGIRYQYNVLP

SEQ ID NO: 2883 - protein, 9 aa, HIV-1
NNETPGIRY

SEQ ID NO: 2884 - protein, 15 aa, HIV-1
NPDCKTILKALGPAA

SEQ ID NO: 2885 - protein, 9 aa, HIV-1
CKTILKALG

SEQ ID NO: 2886 - protein, 15 aa, HIV-1
NPDCKTILKALGPAA

SEQ ID NO: 2887 - protein, 9 aa, HIV-1
KTILKALGP

SEQ ID NO: 2888 - protein, 15 aa, HIV-1
NPDIVIYQYMDDLYV

SEQ ID NO: 2889 - protein, 9 aa, HIV-1
IVIYQYMDD

SEQ ID NO: 2890 - protein, 15 aa, HIV-1
NPLWKGPAKLLWKGE

SEQ ID NO: 2891 - protein, 9 aa, HIV-1
LWKGPAKLL

SEQ ID NO: 2892 - protein, 15 aa, HIV-1
NQKTELQAIYLALQD

SEQ ID NO: 2893 - protein, 9 aa, HIV-1
LQAIYLALQ

SEQ ID NO: 2894 - protein, 15 aa, HIV-1
NREILKEPVHGVYYD

SEQ ID NO: 2895 - protein, 9 aa, HIV-1
ILKEPVHGV

SEQ ID NO: 2896 - protein, 15 aa, HIV-1
NRGRQKVVTLTDTTN

SEQ ID NO: 2897 - protein, 9 aa, HIV-1
RQKVVTLTD

SEQ ID NO: 2898 - protein, 15 aa, HIV-1
NSATIMMQRGNFRNQ

SEQ ID NO: 2899 - protein, 9 aa, HIV-1
IMMQRGNFR

SEQ ID NO: 2900 - protein, 15 aa, HIV-1
NSDIKVVPRRKAKII

SEQ ID NO: 2901 - protein, 9 aa, HIV-1
IKVVPRRKA

SEQ ID NO: 2902 - protein, 15 aa, HIV-1
NTMLNTVGGHQAAMQ

SEQ ID NO: 2903 - protein, 9 aa, HIV-1
LNTVGGHQA

SEQ ID NO: 2904 - protein, 15 aa, HIV-1
NTMLNTVGGHQAAMQ

SEQ ID NO: 2905 - protein, 9 aa, HIV-1
MLNTVGGHQ

SEQ ID NO: 2906 - protein, 15 aa, HIV-1
NTPPLVKLWYQLEKE

SEQ ID NO: 2907 - protein, 9 aa, HIV-1
VKLWYQLEK

SEQ ID NO: 2908 - protein, 15 aa, HIV-1
NTPVFAIKKKDSTKW

SEQ ID NO: 2909 - protein, 9 aa, HIV-1
VFAIKKKDS

SEQ ID NO: 2910 - protein, 15 aa, HIV-1
NTVGGHQAAMQMLKE

SEQ ID NO: 2911 - protein, 9 aa, HIV-1
VGGHQAAMQ

SEQ ID NO: 2912 - protein, 15 aa, HIV-1
NVLPQGWKGSPAIFQ

SEQ ID NO: 2913 - protein, 9 aa, HIV-1
GWKGSPAIF

SEQ ID NO: 2914 - protein, 15 aa, HIV-1
NVLPQGWKGSPAIFQ

SEQ ID NO: 2915 - protein, 9 aa, HIV-1
QGWKGSPAI

SEQ ID NO: 2916 - protein, 15 aa, HIV-1
NWASQIYPGIKVRQL

SEQ ID NO: 2917 - protein, 9 aa, HIV-1
SQIYPGIKV

SEQ ID NO: 2918 - protein, 15 aa, HIV-1
NWRAMASDFNLPPVV

SEQ ID NO: 2919 - protein, 9 aa, HIV-1
MASDFNLPP

SEQ ID NO: 2920 - protein, 15 aa, HIV-1
NWRAMASDFNLPPVV

SEQ ID NO: 2921 - protein, 9 aa, HIV-1
WRAMASDFN

SEQ ID NO: 2922 - protein, 15 aa, HIV-1
NYPIVQNIQGQMVHQ

SEQ ID NO: 2923 - protein, 9 aa, HIV-1
VQNIQGQMV

SEQ ID NO: 2924 - protein, 15 aa, HIV-1
PAGLKKKKSVTVLDV

SEQ ID NO: 2925 - protein, 9 aa, HIV-1
LKKKKSVTV

SEQ ID NO: 2926 - protein, 15 aa, HIV-1
PAIFQSSMTKILEPF

SEQ ID NO: 2927 - protein, 9 aa, HIV-1
FQSSMTKIL

SEQ ID NO: 2928 - protein, 15 aa, HIV-1
PAKLLWKGEGAVVIQ

SEQ ID NO: 2929 - protein, 9 aa, HIV-1
WKGEGAVVI

SEQ ID NO: 2930 - protein, 15 aa, HIV-1
PDCKTILKALGPAAT

SEQ ID NO: 2931 - protein, 9 aa, HIV-1
CKTILKALG

SEQ ID NO: 2932 - protein, 15 aa, HIV-1
PDCKTILKALGPAAT

SEQ ID NO: 2933 - protein, 9 aa, HIV-1
ILKALGPAA

SEQ ID NO: 2934 - protein, 15 aa, HIV-1
PDIVIYQYMDDLYVG

SEQ ID NO: 2935 - protein, 9 aa, HIV-1
YQYMDDLYV

SEQ ID NO: 2936 - protein, 15 aa, HIV-1
PDKWTVQPIVLPEKD

SEQ ID NO: 2937 - protein, 9 aa, HIV-1
WTVQPIVLP

SEQ ID NO: 2938 - protein, 15 aa, HIV-1
PEVIPMFSALSEGAT

SEQ ID NO: 2939 - protein, 9 aa, HIV-1
VIPMFSALS

SEQ ID NO: 2940 - protein, 15 aa, HIV-1
PEWEFVNTPPLVKLW

SEQ ID NO: 2941 - protein, 9 aa, HIV-1
FVNTPPLVK

SEQ ID NO: 2942 - protein, 15 aa, HIV-1
PEWEFVNTPPLVKLW

SEQ ID NO: 2943 - protein, 9 aa, HIV-1
VNTPPLVKL

SEQ ID NO: 2944 - protein, 15 aa, HIV-1
PEWEFVNTPPLVKLW

SEQ ID NO: 2945 - protein, 9 aa, HIV-1
WEFVNTPPL

SEQ ID NO: 2946 - protein, 15 aa, HIV-1
PFKNLKTGKYARMRG

SEQ ID NO: 2947 - protein, 9 aa, HIV-1
FKNLKTGKY

SEQ ID NO: 2948 - protein, 15 aa, HIV-1
PFKNLKTGKYARMRG

SEQ ID NO: 2949 - protein, 9 aa, HIV-1
LKTGKYARM

SEQ ID NO: 2950 - protein, 15 aa, HIV-1
PFRKQNPDIVIYQYM

SEQ ID NO: 2951 - protein, 9 aa, HIV-1
FRKQNPDIV

SEQ ID NO: 2952 - protein, 15 aa, HIV-1
PGHKARVLAEAMSQV

SEQ ID NO: 2953 - protein, 9 aa, HIV-1
ARVLAEAMS

SEQ ID NO: 2954 - protein, 15 aa, HIV-1
PGIKVRQLCKLLRGT

SEQ ID NO: 2955 - protein, 9 aa, HIV-1
VRQLCKLLR

SEQ ID NO: 2956 - protein, 15 aa, HIV-1
PGIRYQYNVLPQGWK

SEQ ID NO: 2957 - protein, 9 aa, HIV-1
IRYQYNVLP

SEQ ID NO: 2958 - protein, 15 aa, HIV-1
PGIRYQYNVLPQGWK

SEQ ID NO: 2959 - protein, 9 aa, HIV-1
YQYNVLPQG

SEQ ID NO: 2960 - protein, 15 aa, HIV-1
PHPAGLKKKKSVTVL

SEQ ID NO: 2961 - protein, 9 aa, HIV-1
LKKKKSVTV

SEQ ID NO: 2962 - protein, 15 aa, HIV-1
PIETVPVKLKPGMDG

SEQ ID NO: 2963 - protein, 9 aa, HIV-1
TVPVKLKPG

SEQ ID NO: 2964 - protein, 15 aa, HIV-1
PIQKETWETWWTEYW

SEQ ID NO: 2965 - protein, 9 aa, HIV-1
KETWETWWT

SEQ ID NO: 2966 - protein, 15 aa, HIV-1
PISPIETVPVKLKPG

SEQ ID NO: 2967 - protein, 9 aa, HIV-1
ISPIETVPV

SEQ ID NO: 2968 - protein, 15 aa, HIV-1
PIVGAETFYVDGAAN

SEQ ID NO: 2969 - protein, 9 aa, HIV-1
IVGAETFYV

SEQ ID NO: 2970 - protein, 15 aa, HIV-1
PIVQNIQGQMVHQAI

SEQ ID NO: 2971 - protein, 9 aa, HIV-1
VQNIQGQMV

SEQ ID NO: 2972 - protein, 15 aa, HIV-1
PKVKQWPLTEEKIKA

SEQ ID NO: 2973 - protein, 9 aa, HIV-1
VKQWPLTEE

SEQ ID NO: 2974 - protein, 15 aa, HIV-1
PLDEDFRKYTAFTIP

SEQ ID NO: 2975 - protein, 9 aa, HIV-1
FRKYTAFTI

SEQ ID NO: 2976 - protein, 15 aa, HIV-1
PLTEEKIKALVEICT

SEQ ID NO: 2977 - protein, 9 aa, HIV-1
LTEEKIKAL

SEQ ID NO: 2978 - protein, 15 aa, HIV-1
PLVKLWYQLEKEPIV

SEQ ID NO: 2979 - protein, 9 aa, HIV-1
VKLWYQLEK

SEQ ID NO: 2980 - protein, 15 aa, HIV-1
PLWKGPAKLLWKGEG

SEQ ID NO: 2981 - protein, 9 aa, HIV-1
LWKGPAKLL

SEQ ID NO: 2982 - protein, 15 aa, HIV-1
PMFSALSEGATPQDL

SEQ ID NO: 2983 - protein, 9 aa, HIV-1
MFSALSEGA

SEQ ID NO: 2984 - protein, 15 aa, HIV-1
PPFLWMGYELHPDKW

SEQ ID NO: 2985 - protein, 9 aa, HIV-1
FLWMGYELH

SEQ ID NO: 2986 - protein, 15 aa, HIV-1
PPLVKLWYQLEKEPI

SEQ ID NO: 2987 - protein, 9 aa, HIV-1
VKLWYQLEK

SEQ ID NO: 2988 - protein, 15 aa, HIV-1
PPVVAKEIVASCDKC

SEQ ID NO: 2989 - protein, 9 aa, HIV-1
VVAKEIVAS

SEQ ID NO: 2990 - protein, 15 aa, HIV-1
PQDLNTMLNTVGGHQ

SEQ ID NO: 2991 - protein, 9 aa, HIV-1
DLNTMLNTV

SEQ ID NO: 2992 - protein, 15 aa, HIV-1
PQDLNTMLNTVGGHQ

SEQ ID NO: 2993 - protein, 9 aa, HIV-1
LNTMLNTVG

SEQ ID NO: 2994 - protein, 15 aa, HIV-1
PQGWKGSPAIFQSSM

SEQ ID NO: 2995 - protein, 9 aa, HIV-1
WKGSPAIFQ

SEQ ID NO: 2996 - protein, 15 aa, HIV-1
PQVTLWQRPLVTIKI

SEQ ID NO: 2997 - protein, 9 aa, HIV-1
LWQRPLVTI

SEQ ID NO: 2998 - protein, 15 aa, HIV-1
PQVTLWQRPLVTIKI

SEQ ID NO: 2999 - protein, 9 aa, HIV-1
TLWQRPLVT

SEQ ID NO: 3000 - protein, 15 aa, HIV-1
PRGSDIAGTTSTLQE

SEQ ID NO: 3001 - protein, 9 aa, HIV-1
IAGTTSTLQ

SEQ ID NO: 3002 - protein, 15 aa, HIV-1
PRTLNAWVKVVEEKA

SEQ ID NO: 3003 - protein, 9 aa, HIV-1
LNAWVKVVE

SEQ ID NO: 3004 - protein, 15 aa, HIV-1
PRTLNAWVKVVEEKA

SEQ ID NO: 3005 - protein, 9 aa, HIV-1
TLNAWVKVV

SEQ ID NO: 3006 - protein, 15 aa, HIV-1
PSINNETPGIRYQYN

SEQ ID NO: 3007 - protein, 9 aa, HIV-1
INNETPGIR

SEQ ID NO: 3008 - protein, 15 aa, HIV-1
PTPVNIIGRNLLTQI

SEQ ID NO: 3009 - protein, 9 aa, HIV-1
IIGRNLLTQ

SEQ ID NO: 3010 - protein, 15 aa, HIV-1
PTPVNIIGRNLLTQI

SEQ ID NO: 3011 - protein, 9 aa, HIV-1
VNIIGRNLL

SEQ ID NO: 3012 - protein, 15 aa, HIV-1
PVFAIKKKDSTKWRK

SEQ ID NO: 3013 - protein, 9 aa, HIV-1
IKKKDSTKW

SEQ ID NO: 3014 - protein, 15 aa, HIV-1
PVGEIYKRWIILGLN

SEQ ID NO: 3015 - protein, 9 aa, HIV-1
YKRWIILGL

SEQ ID NO: 3016 - protein, 15 aa, HIV-1
PVHAGPIAPGQMREP

SEQ ID NO: 3017 - protein, 9 aa, HIV-1
VHAGPIAPG

SEQ ID NO: 3018 - protein, 15 aa, HIV-1
PVKLKPGMDGPKVKQ

SEQ ID NO: 3019 - protein, 9 aa, HIV-1
VKLKPGMDG

SEQ ID NO: 3020 - protein, 15 aa, HIV-1
PVNIIGRNLLTQIGC

SEQ ID NO: 3021 - protein, 9 aa, HIV-1
GRNLLTQIG

SEQ ID NO: 3022 - protein, 15 aa, HIV-1
PVNIIGRNLLTQIGC

SEQ ID NO: 3023 - protein, 9 aa, HIV-1
VNIIGRNLL

SEQ ID NO: 3024 - protein, 15 aa, HIV-1
PVVAKEIVASCDKCQ

SEQ ID NO: 3025 - protein, 9 aa, HIV-1
VVAKEIVAS

SEQ ID NO: 3026 - protein, 15 aa, HIV-1
PAATLEEMMTACQGV

SEQ ID NO: 3027 - protein, 9 aa, HIV-1
LEEMMTACQ

SEQ ID NO: 3028 - protein, 15 aa, HIV-1
QAEHLKTAVQMAVFI

SEQ ID NO: 3029 - protein, 9 aa, HIV-1
LKTAVQMAV

SEQ ID NO: 3030 - protein, 15 aa, HIV-1
QAISPRTLNAWVKVV

SEQ ID NO: 3031 - protein, 9 aa, HIV-1
ISPRTLNAW

SEQ ID NO: 3032 - protein, 15 aa, HIV-1
QAIYLALQDSGLEVN

SEQ ID NO: 3033 - protein, 9 aa, HIV-1
YLALQDSGL

SEQ ID NO: 3034 - protein, 15 aa, HIV-1
QASQEVKNWMTETLL

SEQ ID NO: 3035 - protein, 9 aa, HIV-1
VKNWMTETL

SEQ ID NO: 3036 - protein, 15 aa, HIV-1
QATWIPEWEFVNTPP

SEQ ID NO: 3037 - protein, 9 aa, HIV-1
ATWIPEWEF

SEQ ID NO: 3038 - protein, 15 aa, HIV-1
QDEHEKYHSNWRAMA

SEQ ID NO: 3039 - protein, 9 aa, HIV-1
KYHSNWRAM

SEQ ID NO: 3040 - protein, 15 aa, HIV-1
QDFWEVQLGIPHPAG

SEQ ID NO: 3041 - protein, 9 aa, HIV-1
VQLGIPHPA

SEQ ID NO: 3042 - protein, 15 aa, HIV-1
QDLNTMLNTVGGHQA

SEQ ID NO: 3043 - protein, 9 aa, HIV-1
LNTMLNTVG

SEQ ID NO: 3044 - protein, 15 aa, HIV-1
QDLNTMLNTVGGHQA

SEQ ID NO: 3045 - protein, 9 aa, HIV-1
MLNTVGGHQ

SEQ ID NO: 3046 - protein, 15 aa, HIV-1
QDNSDIKVVPRRKAK

SEQ ID NO: 3047 - protein, 9 aa, HIV-1
IKVVPRRKA

SEQ ID NO: 3048 - protein, 15 aa, HIV-1
QDSGLEVNIVTDSQY

SEQ ID NO: 3049 - protein, 9 aa, HIV-1
LEVNIVTDS

SEQ ID NO: 3050 - protein, 15 aa, HIV-1
QEFGIPYNPQSQGVV

SEQ ID NO: 3051 - protein, 9 aa, HIV-1
PYNPQSQGV

SEQ ID NO: 3052 - protein, 15 aa, HIV-1
QEPFKNLKTGKYARM

SEQ ID NO: 3053 - protein, 9 aa, HIV-1
FKNLKTGKY

SEQ ID NO: 3054 - protein, 15 aa, HIV-1
QEQIGWMTNNPPIPV

SEQ ID NO: 3055 - protein, 9 aa, HIV-1
IGWMTNNPP

SEQ ID NO: 3056 - protein, 15 aa, HIV-1
QETAYFLLKLAGRWP

SEQ ID NO: 3057 - protein, 9 aa, HIV-1
FLLKLAGRW

SEQ ID NO: 3058 - protein, 15 aa, HIV-1
QETAYFLLKLAGRWP

SEQ ID NO: 3059 - protein, 9 aa, HIV-1
YFLLKLAGR

SEQ ID NO: 3060 - protein, 15 aa, HIV-1
QEVKNWMTETLLVQN

SEQ ID NO: 3061 - protein, 9 aa, HIV-1
VKNWMTETL

SEQ ID NO: 3062 - protein, 15 aa, HIV-1
QGKAREFSSEQTRAN

SEQ ID NO: 3063 - protein, 9 aa, HIV-1
AREFSSEQT

SEQ ID NO: 3064 - protein, 15 aa, HIV-1
QGQMVHQAISPRTLN

SEQ ID NO: 3065 - protein, 9 aa, HIV-1
MVHQAISPR

SEQ ID NO: 3066 - protein, 15 aa, HIV-1
QGQMVHQAISPRTLN

SEQ ID NO: 3067 - protein, 9 aa, HIV-1
VHQAISPRT

SEQ ID NO: 3068 - protein, 15 aa, HIV-1
QGTVSFNFPQVTLWQ

SEQ ID NO: 3069 - protein, 9 aa, HIV-1
VSFNFPQVT

SEQ ID NO: 3070 - protein, 15 aa, HIV-1
QGWKGSPAIFQSSMT

SEQ ID NO: 3071 - protein, 9 aa, HIV-1
WKGSPAIFQ

SEQ ID NO: 3072 - protein, 15 aa, HIV-1
QHLLRWGLTTPDKKH

SEQ ID NO: 3073 - protein, 9 aa, HIV-1
LLRWGLTTP

SEQ ID NO: 3074 - protein, 15 aa, HIV-1
QHLLRWGLTTPDKKH

SEQ ID NO: 3075 - protein, 9 aa, HIV-1
LRWGLTTPD

SEQ ID NO: 3076 - protein, 15 aa, HIV-1
QHLLRWGLTTPDKKH

SEQ ID NO: 3077 - protein, 9 aa, HIV-1
WGLTTPDKK

SEQ ID NO: 3078 - protein, 15 aa, HIV-1
QIGWMTNNPPIPVGE

SEQ ID NO: 3079 - protein, 9 aa, HIV-1
IGWMTNNPP

SEQ ID NO: 3080 - protein, 15 aa, HIV-1
QIGWMTNNPPIPVGE

SEQ ID NO: 3081 - protein, 9 aa, HIV-1
MTNNPPIPV

SEQ ID NO: 3082 - protein, 15 aa, HIV-1
QIGWMTNNPPIPVGE

SEQ ID NO: 3083 - protein, 9 aa, HIV-1
WMTNNPPIP

SEQ ID NO: 3084 - protein, 15 aa, HIV-1
QIIEQLIKKEKVYLA

SEQ ID NO: 3085 - protein, 9 aa, HIV-1
LIKKEKVYL

SEQ ID NO: 3086 - protein, 15 aa, HIV-1
QILGQLQPSLQTGSE

SEQ ID NO: 3087 - protein, 9 aa, HIV-1
GQLQPSLQT

SEQ ID NO: 3088 - protein, 15 aa, HIV-1
QILGQLQPSLQTGSE

SEQ ID NO: 3089 - protein, 9 aa, HIV-1
LGQLQPSLQ

SEQ ID NO: 3090 - protein, 15 aa, HIV-1
QILIEICGHKAIGTV

SEQ ID NO: 3091 - protein, 9 aa, HIV-1
ICGHKAIGT

SEQ ID NO: 3092 - protein, 15 aa, HIV-1
QITKIQNFRVYYRDS

SEQ ID NO: 3093 - protein, 9 aa, HIV-1
IQNFRVYYR

SEQ ID NO: 3094 - protein, 15 aa, HIV-1
QITKIQNFRVYYRDS

SEQ ID NO: 3095 - protein, 9 aa, HIV-1
ITKIQNFRV

SEQ ID NO: 3096 - protein, 15 aa, HIV-1
QIYPGIKVRQLCKLL

SEQ ID NO: 3097 - protein, 9 aa, HIV-1
YPGIKVRQL

SEQ ID NO: 3098 - protein, 15 aa, HIV-1
QIYQEPFKNLKTGKY

SEQ ID NO: 3099 - protein, 9 aa, HIV-1
IYQEPFKNL

SEQ ID NO: 3100 - protein, 15 aa, HIV-1
QIYQEPFKNLKTGKY

SEQ ID NO: 3101 - protein, 9 aa, HIV-1
PFKNLKTGK

SEQ ID NO: 3102 - protein, 15 aa, HIV-1
QIYQEPFKNLKTGKY

SEQ ID NO: 3103 - protein, 9 aa, HIV-1
YQEPFKNLK

SEQ ID NO: 3104 - protein, 15 aa, HIV-1
QKEPPFLWMGYELHP

SEQ ID NO: 3105 - protein, 9 aa, HIV-1
FLWMGYELH

SEQ ID NO: 3106 - protein, 15 aa, HIV-1
QKETWETWWTEYWQA

SEQ ID NO: 3107 - protein, 9 aa, HIV-1
WETWWTEYW

SEQ ID NO: 3108 - protein, 15 aa, HIV-1
QKLVGKLNWASQIYP

SEQ ID NO: 3109 - protein, 9 aa, HIV-1
KLNWASQIY

SEQ ID NO: 3110 - protein, 15 aa, HIV-1
QKLVGKLNWASQIYP

SEQ ID NO: 3111 - protein, 9 aa, HIV-1
LVGKLNWAS

SEQ ID NO: 3112 - protein, 15 aa, HIV-1
QKQITKIQNFRVYYR

SEQ ID NO: 3113 - protein, 9 aa, HIV-1
ITKIQNFRV

SEQ ID NO: 3114 - protein, 15 aa, HIV-1
QKQITKIQNFRVYYR

SEQ ID NO: 3115 - protein, 9 aa, HIV-1
TKIQNFRVY

SEQ ID NO: 3116 - protein, 15 aa, HIV-1
QKTELQAIYLALQDS

SEQ ID NO: 3117 - protein, 9 aa, HIV-1
LQAIYLALQ

SEQ ID NO: 3118 - protein, 15 aa, HIV-1
QKVVTLTDTTNQKTE

SEQ ID NO: 3119 - protein, 9 aa, HIV-1
LTDTTNQKT

SEQ ID NO: 3120 - protein, 15 aa, HIV-1
QKVVTLTDTTNQKTE

SEQ ID NO: 3121 - protein, 9 aa, HIV-1
VTLTDTTNQ

SEQ ID NO: 3122 - protein, 15 aa, HIV-1
QLCKLLRGTKALTEV

SEQ ID NO: 3123 - protein, 9 aa, HIV-1
LRGTKALTE

SEQ ID NO: 3124 - protein, 15 aa, HIV-1
QLEKEPIVGAETFYV

SEQ ID NO: 3125 - protein, 9 aa, HIV-1
LEKEPIVGA

SEQ ID NO: 3126 - protein, 15 aa, HIV-1
QLIKKEKVYLAWVPA

SEQ ID NO: 3127 - protein, 9 aa, HIV-1
IKKEKVYLA

SEQ ID NO: 3128 - protein, 15 aa, HIV-1
QLTEAVQKITTESIV

SEQ ID NO: 3129 - protein, 9 aa, HIV-1
VQKITTESI

SEQ ID NO: 3130 - protein, 15 aa, HIV-1
QMAVFIHNFKRKGGI

SEQ ID NO: 3131 - protein, 9 aa, HIV-1
FIHNFKRKG

SEQ ID NO: 3132 - protein, 15 aa, HIV-1
QMAVFIHNFKRKGGI

SEQ ID NO: 3133 - protein, 9 aa, HIV-1
VFIHNFKRK

SEQ ID NO: 3134 - protein, 15 aa, HIV-1
QMVHQAISPRTLNAW

SEQ ID NO: 3135 - protein, 9 aa, HIV-1
MVHQAISPR

SEQ ID NO: 3136 - protein, 15 aa, HIV-1
QMVHQAISPRTLNAW

SEQ ID NO: 3137 - protein, 9 aa, HIV-1
VHQAISPRT

SEQ ID NO: 3138 - protein, 15 aa, HIV-1
QNFRVYYRDSRNPLW

SEQ ID NO: 3139 - protein, 9 aa, HIV-1
FRVYYRDSR

SEQ ID NO: 3140 - protein, 15 aa, HIV-1
QNFRVYYRDSRNPLW

SEQ ID NO: 3141 - protein, 9 aa, HIV-1
YYRDSRNPL

SEQ ID NO: 3142 - protein, 15 aa, HIV-1
QNIQGQMVHQAISPR

SEQ ID NO: 3143 - protein, 9 aa, HIV-1
IQGQMVHQA

SEQ ID NO: 3144 - protein, 15 aa, HIV-1
QNYPIVQNIQGQMVH

SEQ ID NO: 3145 - protein, 9 aa, HIV-1
VQNIQGQMV

SEQ ID NO: 3146 - protein, 15 aa, HIV-1
QRGNFRNQRKIVKCF

SEQ ID NO: 3147 - protein, 9 aa, HIV-1
FRNQRKIVK

SEQ ID NO: 3148 - protein, 15 aa, HIV-1
QSESELVNQIIEQLI

SEQ ID NO: 3149 - protein, 9 aa, HIV-1
LVNQIIEQL

SEQ ID NO: 3150 - protein, 15 aa, HIV-1
QSSMTKILEPFRKQN

SEQ ID NO: 3151 - protein, 9 aa, HIV-1
TKILEPFRK

SEQ ID NO: 3152 - protein, 15 aa, HIV-1
QTGSEELRSLYNTVA

SEQ ID NO: 3153 - protein, 9 aa, HIV-1
SEELRSLYN

SEQ ID NO: 3154 - protein, 15 aa, HIV-1
QTKELQKQITKIQNF

SEQ ID NO: 3155 - protein, 9 aa, HIV-1
LQKQITKIQ

SEQ ID NO: 3156 - protein, 15 aa, HIV-1
QVDKLVSAGIRKVLF

SEQ ID NO: 3157 - protein, 9 aa, HIV-1
LVSAGIRKV

SEQ ID NO: 3158 - protein, 15 aa, HIV-1
QVTLWQRPLVTIKIG

SEQ ID NO: 3159 - protein, 9 aa, HIV-1
LWQRPLVTI

SEQ ID NO: 3160 - protein, 15 aa, HIV-1
QVTLWQRPLVTIKIG

SEQ ID NO: 3161 - protein, 9 aa, HIV-1
TLWQRPLVT

SEQ ID NO: 3162 - protein, 15 aa, HIV-1
QVTNSATIMMQRGNF

SEQ ID NO: 3163 - protein, 9 aa, HIV-1
VTNSATIMM

SEQ ID NO: 3164 - protein, 15 aa, HIV-1
QYALGIIQAQPDQSE

SEQ ID NO: 3165 - protein, 9 aa, HIV-1
IIQAQPDQS

SEQ ID NO: 3166 - protein, 15 aa, HIV-1
QYALGIIQAQPDQSE

SEQ ID NO: 3167 - protein, 9 aa, HIV-1
LGIIQAQPD

SEQ ID NO: 3168 - protein, 15 aa, HIV-1
QYMDDLYVGSDLEIG

SEQ ID NO: 3169 - protein, 9 aa, HIV-1
LYVGSDLEI

SEQ ID NO: 3170 - protein, 15 aa, HIV-1
RAMASDFNLPPVVAK

SEQ ID NO: 3171 - protein, 9 aa, HIV-1
DFNLPPVVA

SEQ ID NO: 3172 - protein, 15 aa, HIV-1
RAMASDFNLPPVVAK

SEQ ID NO: 3173 - protein, 9 aa, HIV-1
MASDFNLPP

SEQ ID NO: 3174 - protein, 15 aa, HIV-1
RDQAEHLKTAVQMAV

SEQ ID NO: 3175 - protein, 9 aa, HIV-1
HLKTAVQMA

SEQ ID NO: 3176 - protein, 15 aa, HIV-1
RDSRNPLWKGPAKLL

SEQ ID NO: 3177 - protein, 9 aa, HIV-1
PLWKGPAKL

SEQ ID NO: 3178 - protein, 15 aa, HIV-1
RDYVDRFYKTLRAEQ

SEQ ID NO: 3179 - protein, 9 aa, HIV-1
DRFYKTLRA

SEQ ID NO: 3180 - protein, 15 aa, HIV-1
RDYVDRFYKTLRAEQ

SEQ ID NO: 3181 - protein, 9 aa, HIV-1
DYVDRFYKT

SEQ ID NO: 3182 - protein, 15 aa, HIV-1
RDYVDRFYKTLRAEQ

SEQ ID NO: 3183 - protein, 9 aa, HIV-1
VDRFYKTLR

SEQ ID NO: 3184 - protein, 15 aa, HIV-1
REDLAFLQGKAREFS

SEQ ID NO: 3185 - protein, 9 aa, HIV-1
FLQGKAREF

SEQ ID NO: 3186 - protein, 15 aa, HIV-1
REDLAFLQGKAREFS

SEQ ID NO: 3187 - protein, 9 aa, HIV-1
LAFLQGKAR

SEQ ID NO: 3188 - protein, 15 aa, HIV-1
REFSSEQTRANSPTR

SEQ ID NO: 3189 - protein, 9 aa, HIV-1
FSSEQTRAN

SEQ ID NO: 3190 - protein, 15 aa, HIV-1
RELERFAVNPGLLET

SEQ ID NO: 3191 - protein, 9 aa, HIV-1
FAVNPGLLE

SEQ ID NO: 3192 - protein, 15 aa, HIV-1
RELERFAVNPGLLET

SEQ ID NO: 3193 - protein, 9 aa, HIV-1
LERFAVNPG

SEQ ID NO: 3194 - protein, 15 aa, HIV-1
RELQVWGRDNNSPSE

SEQ ID NO: 3195 - protein, 9 aa, HIV-1
WGRDNNSPS

SEQ ID NO: 3196 - protein, 15 aa, HIV-1
RFAVNPGLLETSEGC

SEQ ID NO: 3197 - protein, 9 aa, HIV-1
FAVNPGLLE

SEQ ID NO: 3198 - protein, 15 aa, HIV-1
RFAVNPGLLETSEGC

SEQ ID NO: 3199 - protein, 9 aa, HIV-1
VNPGLLETS

SEQ ID NO: 3200 - protein, 15 aa, HIV-1
RFYKTLRAEQASQEV

SEQ ID NO: 3201 - protein, 9 aa, HIV-1
FYKTLRAEQ

SEQ ID NO: 3202 - protein, 15 aa, HIV-1
RFYKTLRAEQASQEV

SEQ ID NO: 3203 - protein, 9 aa, HIV-1
YKTLRAEQA

SEQ ID NO: 3204 - protein, 15 aa, HIV-1
RGNFRNQRKIVKCFN

SEQ ID NO: 3205 - protein, 9 aa, HIV-1
FRNQRKIVK

SEQ ID NO: 3206 - protein, 15 aa, HIV-1
RGRQKVVTLTDTTNQ

SEQ ID NO: 3207 - protein, 9 aa, HIV-1
KVVTLTDTT

SEQ ID NO: 3208 - protein, 15 aa, HIV-1
RGRQKVVTLTDTTNQ

SEQ ID NO: 3209 - protein, 9 aa, HIV-1
RQKVVTLTD

SEQ ID NO: 3210 - protein, 15 aa, HIV-1
RGRQKVVTLTDTTNQ

SEQ ID NO: 3211 - protein, 9 aa, HIV-1
VVTLTDTTN

SEQ ID NO: 3212 - protein, 15 aa, HIV-1
RGSDIAGTTSTLQEQ

SEQ ID NO: 3213 - protein, 9 aa, HIV-1
IAGTTSTLQ

SEQ ID NO: 3214 - protein, 15 aa, HIV-1
RKLVDFRELNKRTQD

SEQ ID NO: 3215 - protein, 9 aa, HIV-1
FRELNKRTQ

SEQ ID NO: 3216 - protein, 15 aa, HIV-1
RKLVDFRELNKRTQD

SEQ ID NO: 3217 - protein, 9 aa, HIV-1
VDFRELNKR

SEQ ID NO: 3218 - protein, 15 aa, HIV-1
RKYTAFTIPSINNET

SEQ ID NO: 3219 - protein, 9 aa, HIV-1
YTAFTIPSI

SEQ ID NO: 3220 - protein, 15 aa, HIV-1
RMRGAHTNDVKQLTE

SEQ ID NO: 3221 - protein, 9 aa, HIV-1
MRGAHTNDV

SEQ ID NO: 3222 - protein, 15 aa, HIV-1
RMYSPTSILDIRQGP

SEQ ID NO: 3223 - protein, 9 aa, HIV-1
YSPTSILDI

SEQ ID NO: 3224 - protein, 15 aa, HIV-1
RNPLWKGPAKLLWKG

SEQ ID NO: 3225 - protein, 9 aa, HIV-1
LWKGPAKLL

SEQ ID NO: 3226 - protein, 15 aa, HIV-1
RQGTVSFNFPQVTLW

SEQ ID NO: 3227 - protein, 9 aa, HIV-1
VSFNFPQVT

SEQ ID NO: 3228 - protein, 15 aa, HIV-1
RQHLLRWGLTTPDKK

SEQ ID NO: 3229 - protein, 9 aa, HIV-1
LLRWGLTTP

SEQ ID NO: 3230 - protein, 15 aa, HIV-1
RQHLLRWGLTTPDKK

SEQ ID NO: 3231 - protein, 9 aa, HIV-1
LRWGLTTPD

SEQ ID NO: 3232 - protein, 15 aa, HIV-1
RQHLLRWGLTTPDKK

SEQ ID NO: 3233 - protein, 9 aa, HIV-1
RWGLTTPDK

SEQ ID NO: 3234 - protein, 15 aa, HIV-1
RQILGQLQPSLQTGS

SEQ ID NO: 3235 - protein, 9 aa, HIV-1
GQLQPSLQT

SEQ ID NO: 3236 - protein, 15 aa, HIV-1
RQILGQLQPSLQTGS

SEQ ID NO: 3237 - protein, 9 aa, HIV-1
LGQLQPSLQ

SEQ ID NO: 3238 - protein, 15 aa, HIV-1
RQKVVTLTDTTNQKT

SEQ ID NO: 3239 - protein, 9 aa, HIV-1
VTLTDTTNQ

SEQ ID NO: 3240 - protein, 15 aa, HIV-1
RQKVVTLTDTTNQKT

SEQ ID NO: 3241 - protein, 9 aa, HIV-1
VVTLTDTTN

SEQ ID NO: 3242 - protein, 15 aa, HIV-1
RQLCKLLRGTKALTE

SEQ ID NO: 3243 - protein, 9 aa, HIV-1
CKLLRGTKA

SEQ ID NO: 3244 - protein, 15 aa, HIV-1
RRELQVWGRDNNSPS

SEQ ID NO: 3245 - protein, 9 aa, HIV-1
LQVWGRDNN

SEQ ID NO: 3246 - protein, 15 aa, HIV-1
RSLYNTVATLYCVHQ

SEQ ID NO: 3247 - protein, 9 aa, HIV-1
LYNTVATLY

SEQ ID NO: 3248 - protein, 15 aa, HIV-1
RSLYNTVATLYCVHQ

SEQ ID NO: 3249 - protein, 9 aa, HIV-1
YNTVATLYC

SEQ ID NO: 3250 - protein, 15 aa, HIV-1
RTKIEELRQHLLRWG

SEQ ID NO: 3251 - protein, 9 aa, HIV-1
ELRQHLLRW

SEQ ID NO: 3252 - protein, 15 aa, HIV-1
RTKIEELRQHLLRWG

SEQ ID NO: 3253 - protein, 9 aa, HIV-1
IEELRQHLL

SEQ ID NO: 3254 - protein, 15 aa, HIV-1
RTLNAWVKVVEEKAF

SEQ ID NO: 3255 - protein, 9 aa, HIV-1
LNAWVKVVE

SEQ ID NO: 3256 - protein, 15 aa, HIV-1
RTLNAWVKVVEEKAF

SEQ ID NO: 3257 - protein, 9 aa, HIV-1
TLNAWVKVV

SEQ ID NO: 3258 - protein, 15 aa, HIV-1
RVHPVHAGPIAPGQM

SEQ ID NO: 3259 - protein, 9 aa, HIV-1
VHAGPIAPG

SEQ ID NO: 3260 - protein, 15 aa, HIV-1
RVLAEAMSQVTNSAT

SEQ ID NO: 3261 - protein, 9 aa, HIV-1
AMSQVTNSA

SEQ ID NO: 3262 - protein, 15 aa, HIV-1
RVLAEAMSQVTNSAT

SEQ ID NO: 3263 - protein, 9 aa, HIV-1
LAEAMSQVT

SEQ ID NO: 3264 - protein, 15 aa, HIV-1
RVYYRDSRNPLWKGP

SEQ ID NO: 3265 - protein, 9 aa, HIV-1
YRDSRNPLW

SEQ ID NO: 3266 - protein, 15 aa, HIV-1
RVYYRDSRNPLWKGP

SEQ ID NO: 3267 - protein, 9 aa, HIV-1
YYRDSRNPL

SEQ ID NO: 3268 - protein, 15 aa, HIV-1
RWGLTTPDKKHQKEP

SEQ ID NO: 3269 - protein, 9 aa, HIV-1
WGLTTPDKK

SEQ ID NO: 3270 - protein, 15 aa, HIV-1
RWIILGLNKIVRMYS

SEQ ID NO: 3271 - protein, 9 aa, HIV-1
ILGLNKIVR

SEQ ID NO: 3272 - protein, 15 aa, HIV-1
RWIILGLNKIVRMYS

SEQ ID NO: 3273 - protein, 9 aa, HIV-1
LGLNKIVRM

SEQ ID NO: 3274 - protein, 15 aa, HIV-1
RWIILGLNKIVRMYS

SEQ ID NO: 3275 - protein, 9 aa, HIV-1
WIILGLNKI

SEQ ID NO: 3276 - protein, 15 aa, HIV-1
RWPVKTIHTDNGSNF

SEQ ID NO: 3277 - protein, 9 aa, HIV-1
VKTIHTDNG

SEQ ID NO: 3278 - protein, 15 aa, HIV-1
SAGERIVDIIATDIQ

SEQ ID NO: 3279 - protein, 9 aa, HIV-1
IVDIIATDI

SEQ ID NO: 3280 - protein, 15 aa, HIV-1
SATIMMQRGNFRNQR

SEQ ID NO: 3281 - protein, 9 aa, HIV-1
IMMQRGNFR

SEQ ID NO: 3282 - protein, 15 aa, HIV-1
SCDKCQLKGEAMHGQ

SEQ ID NO: 3283 - protein, 9 aa, HIV-1
QLKGEAMHG

SEQ ID NO: 3284 - protein, 15 aa, HIV-1
SDFNLPPVVAKEIVA

SEQ ID NO: 3285 - protein, 9 aa, HIV-1
FNLPPVVAK

SEQ ID NO: 3286 - protein, 15 aa, HIV-1
SDIAGTTSTLQEQIG

SEQ ID NO: 3287 - protein, 9 aa, HIV-1
IAGTTSTLQ

SEQ ID NO: 3288 - protein, 15 aa, HIV-1
SDIKVVPRRKAKIIR

SEQ ID NO: 3289 - protein, 9 aa, HIV-1
IKVVPRRKA

SEQ ID NO: 3290 - protein, 15 aa, HIV-1
SDIKVVPRRKAKIIR

SEQ ID NO: 3291 - protein, 9 aa, HIV-1
VVPRRKAKI

SEQ ID NO: 3292 - protein, 15 aa, HIV-1
SEELRSLYNTVATLY

SEQ ID NO: 3293 - protein, 9 aa, HIV-1
LRSLYNTVA

SEQ ID NO: 3294 - protein, 15 aa, HIV-1
SELVNQIIEQLIKKE

SEQ ID NO: 3295 - protein, 9 aa, HIV-1
LVNQIIEQL

SEQ ID NO: 3296 - protein, 15 aa, HIV-1
SESELVNQIIEQLIK

SEQ ID NO: 3297 - protein, 9 aa, HIV-1
LVNQIIEQL

SEQ ID NO: 3298 - protein, 15 aa, HIV-1
SGLEVNIVTDSQYAL

SEQ ID NO: 3299 - protein, 9 aa, HIV-1
LEVNIVTDS

SEQ ID NO: 3300 - protein, 15 aa, HIV-1
SINNETPGIRYQYNV

SEQ ID NO: 3301 - protein, 9 aa, HIV-1
INNETPGIR

SEQ ID NO: 3302 - protein, 15 aa, HIV-1
SIVIWGKTPKFKLPI

SEQ ID NO: 3303 - protein, 9 aa, HIV-1
IVIWGKTPK

SEQ ID NO: 3304 - protein, 15 aa, HIV-1
SIVIWGKTPKFKLPI

SEQ ID NO: 3305 - protein, 9 aa, HIV-1
IWGKTPKFK

SEQ ID NO: 3306 - protein, 15 aa, HIV-1
SIVIWGKTPKFKLPI

SEQ ID NO: 3307 - protein, 9 aa, HIV-1
VIWGKTPKF

SEQ ID NO: 3308 - protein, 15 aa, HIV-1
SKIGPENPYNTPVFA

SEQ ID NO: 3309 - protein, 9 aa, HIV-1
IGPENPYNT

SEQ ID NO: 3310 - protein, 15 aa, HIV-1
SLYNTVATLYCVHQR

SEQ ID NO: 3311 - protein, 9 aa, HIV-1
LYNTVATLY

SEQ ID NO: 3312 - protein, 15 aa, HIV-1
SLYNTVATLYCVHQR

SEQ ID NO: 3313 - protein, 9 aa, HIV-1
YNTVATLYC

SEQ ID NO: 3314 - protein, 15 aa, HIV-1
SMNKELKKIIGQVRD

SEQ ID NO: 3315 - protein, 9 aa, HIV-1
LKKIIGQVR

SEQ ID NO: 3316 - protein, 15 aa, HIV-1
SMTKILEPFRKQNPD

SEQ ID NO: 3317 - protein, 9 aa, HIV-1
TKILEPFRK

SEQ ID NO: 3318 - protein, 15 aa, HIV-1
SNFTGATVRAACWWA

SEQ ID NO: 3319 - protein, 9 aa, HIV-1
FTGATVRAA

SEQ ID NO: 3320 - protein, 15 aa, HIV-1
SNWRAMASDFNLPPV

SEQ ID NO: 3321 - protein, 9 aa, HIV-1
MASDFNLPP

SEQ ID NO: 3322 - protein, 15 aa, HIV-1
SNWRAMASDFNLPPV

SEQ ID NO: 3323 - protein, 9 aa, HIV-1
WRAMASDFN

SEQ ID NO: 3324 - protein, 15 aa, HIV-1
SPAIFQSSMTKILEP

SEQ ID NO: 3325 - protein, 9 aa, HIV-1
FQSSMTKIL

SEQ ID NO: 3326 - protein, 15 aa, HIV-1
SPEVIPMFSALSEGA

SEQ ID NO: 3327 - protein, 9 aa, HIV-1
VIPMFSALS

SEQ ID NO: 3328 - protein, 15 aa, HIV-1
SPRTLNAWVKVVEEK

SEQ ID NO: 3329 - protein, 9 aa, HIV-1
LNAWVKVVE

SEQ ID NO: 3330 - protein, 15 aa, HIV-1
SPRTLNAWVKVVEEK

SEQ ID NO: 3331 - protein, 9 aa, HIV-1
TLNAWVKVV

SEQ ID NO: 3332 - protein, 15 aa, HIV-1
SQEVKNWMTETLLVQ

SEQ ID NO: 3333 - protein, 9 aa, HIV-1
VKNWMTETL

SEQ ID NO: 3334 - protein, 15 aa, HIV-1
SQIYPGIKVRQLCKL

SEQ ID NO: 3335 - protein, 9 aa, HIV-1
YPGIKVRQL

SEQ ID NO: 3336 - protein, 15 aa, HIV-1
SQNYPIVQNIQGQMV

SEQ ID NO: 3337 - protein, 9 aa, HIV-1
IVQNIQGQM

SEQ ID NO: 3338 - protein, 15 aa, HIV-1
SQNYPIVQNIQGQMV

SEQ ID NO: 3339 - protein, 9 aa, HIV-1
SQNYPIVQN

SEQ ID NO: 3340 - protein, 15 aa, HIV-1
SQVTNSATIMMQRGN

SEQ ID NO: 3341 - protein, 9 aa, HIV-1
VTNSATIMM

SEQ ID NO: 3342 - protein, 15 aa, HIV-1
SQYALGIIQAQPDQS

SEQ ID NO: 3343 - protein, 9 aa, HIV-1
LGIIQAQPD

SEQ ID NO: 3344 - protein, 15 aa, HIV-1
SQYALGIIQAQPDQS

SEQ ID NO: 3345 - protein, 9 aa, HIV-1
YALGIIQAQ

SEQ ID NO: 3346 - protein, 15 aa, HIV-1
SRELERFAVNPGLLE

SEQ ID NO: 3347 - protein, 9 aa, HIV-1
LERFAVNPG

SEQ ID NO: 3348 - protein, 15 aa, HIV-1
SRNPLWKGPAKLLWK

SEQ ID NO: 3349 - protein, 9 aa, HIV-1
LWKGPAKLL

SEQ ID NO: 3350 - protein, 15 aa, HIV-1
SSEQTRANSPTRREL

SEQ ID NO: 3351 - protein, 9 aa, HIV-1
QTRANSPTR

SEQ ID NO: 3352 - protein, 15 aa, HIV-1
SSMTKILEPFRKQNP

SEQ ID NO: 3353 - protein, 9 aa, HIV-1
TKILEPFRK

SEQ ID NO: 3354 - protein, 15 aa, HIV-1
STLQEQIGWMTNNPP

SEQ ID NO: 3355 - protein, 9 aa, HIV-1
LQEQIGWMT

SEQ ID NO: 3356 - protein, 15 aa, HIV-1
STLQEQIGWMTNNPP

SEQ ID NO: 3357 - protein, 9 aa, HIV-1
QIGWMTNNP

SEQ ID NO: 3358 - protein, 15 aa, HIV-1
SWTVNDIQKLVGKLN

SEQ ID NO: 3359 - protein, 9 aa, HIV-1
VNDIQKLVG

SEQ ID NO: 3360 - protein, 15 aa, HIV-1
TAVQMAVFIHNFKRK

SEQ ID NO: 3361 - protein, 9 aa, HIV-1
VQMAVFIHN

SEQ ID NO: 3362 - protein, 15 aa, HIV-1
TAYFLLKLAGRWPVK

SEQ ID NO: 3363 - protein, 9 aa, HIV-1
FLLKLAGRW

SEQ ID NO: 3364 - protein, 15 aa, HIV-1
TAYFLLKLAGRWPVK

SEQ ID NO: 3365 - protein, 9 aa, HIV-1
LKLAGRWPV

SEQ ID NO: 3366 - protein, 15 aa, HIV-1
TAYFLLKLAGRWPVK

SEQ ID NO: 3367 - protein, 9 aa, HIV-1
YFLLKLAGR

SEQ ID NO: 3368 - protein, 15 aa, HIV-1
TDIQTKELQKQITKI

SEQ ID NO: 3369 - protein, 9 aa, HIV-1
IQTKELQKQ

SEQ ID NO: 3370 - protein, 15 aa, HIV-1
TDNGSNFTGATVRAA

SEQ ID NO: 3371 - protein, 9 aa, HIV-1
NFTGATVRA

SEQ ID NO: 3372 - protein, 15 aa, HIV-1
TDSQYALGIIQAQPD

SEQ ID NO: 3373 - protein, 9 aa, HIV-1
YALGIIQAQ

SEQ ID NO: 3374 - protein, 15 aa, HIV-1
TEAVQKITTESIVIW

SEQ ID NO: 3375 - protein, 9 aa, HIV-1
VQKITTESI

SEQ ID NO: 3376 - protein, 15 aa, HIV-1
TEEKIKALVEICTEM

SEQ ID NO: 3377 - protein, 9 aa, HIV-1
IKALVEICT

SEQ ID NO: 3378 - protein, 15 aa, HIV-1
TELQAIYLALQDSGL

SEQ ID NO: 3379 - protein, 9 aa, HIV-1
LQAIYLALQ

SEQ ID NO: 3380 - protein, 15 aa, HIV-1
TESIVIWGKTPKFKL

SEQ ID NO: 3381 - protein, 9 aa, HIV-1
IVIWGKTPK

SEQ ID NO: 3382 - protein, 15 aa, HIV-1
TESIVIWGKTPKFKL

SEQ ID NO: 3383 - protein, 9 aa, HIV-1
IWGKTPKFK

SEQ ID NO: 3384 - protein, 15 aa, HIV-1
TESIVIWGKTPKFKL

SEQ ID NO: 3385 - protein, 9 aa, HIV-1
VIWGKTPKF

SEQ ID NO: 3386 - protein, 15 aa, HIV-1
TETLLVQNANPDCKT

SEQ ID NO: 3387 - protein, 9 aa, HIV-1
VQNANPDCK

SEQ ID NO: 3388 - protein, 15 aa, HIV-1
TEYWQATWIPEWEFV

SEQ ID NO: 3389 - protein, 9 aa, HIV-1
WQATWIPEW

SEQ ID NO: 3390 - protein, 15 aa, HIV-1
TFYVDGAANRETKLG

SEQ ID NO: 3391 - protein, 9 aa, HIV-1
YVDGAANRE

SEQ ID NO: 3392 - protein, 15 aa, HIV-1
TGATVRAACWWAGIK

SEQ ID NO: 3393 - protein, 9 aa, HIV-1
VRAACWWAG

SEQ ID NO: 3394 - protein, 15 aa, HIV-1
TGKYARMRGAHTNDV

SEQ ID NO: 3395 - protein, 9 aa, HIV-1
YARMRGAHT

SEQ ID NO: 3396 - protein, 15 aa, HIV-1
TGQETAYFLLKLAGR

SEQ ID NO: 3397 - protein, 9 aa, HIV-1
TAYFLLKLA

SEQ ID NO: 3398 - protein, 15 aa, HIV-1
TGSEELRSLYNTVAT

SEQ ID NO: 3399 - protein, 9 aa, HIV-1
LRSLYNTVA

SEQ ID NO: 3400 - protein, 15 aa, HIV-1
THLEGKVILVAVHVA

SEQ ID NO: 3401 - protein, 9 aa, HIV-1
KVILVAVHV

SEQ ID NO: 3402 - protein, 15 aa, HIV-1
TILKALGPAATLEEM

SEQ ID NO: 3403 - protein, 9 aa, HIV-1
LKALGPAAT

SEQ ID NO: 3404 - protein, 15 aa, HIV-1
TIMMQRGNFRNQRKI

SEQ ID NO: 3405 - protein, 9 aa, HIV-1
IMMQRGNFR

SEQ ID NO: 3406 - protein, 15 aa, HIV-1
TIPSINNETPGIRYQ

SEQ ID NO: 3407 - protein, 9 aa, HIV-1
INNETPGIR

SEQ ID NO: 3408 - protein, 15 aa, HIV-1
TKELQKQITKIQNFR

SEQ ID NO: 3409 - protein, 9 aa, HIV-1
LQKQITKIQ

SEQ ID NO: 3410 - protein, 15 aa, HIV-1
TKIEELRQHLLRWGL

SEQ ID NO: 3411 - protein, 9 aa, HIV-1
LRQHLLRWG

SEQ ID NO: 3412 - protein, 15 aa, HIV-1
TKILEPFRKQNPDIV

SEQ ID NO: 3413 - protein, 9 aa, HIV-1
TKILEPFRK

SEQ ID NO: 3414 - protein, 15 aa, HIV-1
TKIQNFRVYYRDSRN

SEQ ID NO: 3415 - protein, 9 aa, HIV-1
IQNFRVYYR

SEQ ID NO: 3416 - protein, 15 aa, HIV-1
TKWRKLVDFRELNKR

SEQ ID NO: 3417 - protein, 9 aa, HIV-1
WRKLVDFRE

SEQ ID NO: 3418 - protein, 15 aa, HIV-1
TLEEMMTACQGVGGP

SEQ ID NO: 3419 - protein, 9 aa, HIV-1
MTACQGVGG

SEQ ID NO: 3420 - protein, 15 aa, HIV-1
TLLVQNANPDCKTIL

SEQ ID NO: 3421 - protein, 9 aa, HIV-1
VQNANPDCK

SEQ ID NO: 3422 - protein, 15 aa, HIV-1
TLNAWVKVVEEKAFS

SEQ ID NO: 3423 - protein, 9 aa, HIV-1
LNAWVKVVE

SEQ ID NO: 3424 - protein, 15 aa, HIV-1
TLNFPISPIETVPVK

SEQ ID NO: 3425 - protein, 9 aa, HIV-1
ISPIETVPV

SEQ ID NO: 3426 - protein, 15 aa, HIV-1
TLQEQIGWMTNNPPI

SEQ ID NO: 3427 - protein, 9 aa, HIV-1
IGWMTNNPP

SEQ ID NO: 3428 - protein, 15 aa, HIV-1
TLWQRPLVTIKIGGQ

SEQ ID NO: 3429 - protein, 9 aa, HIV-1
LWQRPLVTI

SEQ ID NO: 3430 - protein, 15 aa, HIV-1
TMLNTVGGHQAAMQM

SEQ ID NO: 3431 - protein, 9 aa, HIV-1
MLNTVGGHQ

SEQ ID NO: 3432 - protein, 15 aa, HIV-1
TMLNTVGGHQAAMQM

SEQ ID NO: 3433 - protein, 9 aa, HIV-1
VGGHQAAMQ

SEQ ID NO: 3434 - protein, 15 aa, HIV-1
TNQKTELQAIYLALQ

SEQ ID NO: 3435 - protein, 9 aa, HIV-1
KTELQAIYL

SEQ ID NO: 3436 - protein, 15 aa, HIV-1
TNSATIMMQRGNFRN

SEQ ID NO: 3437 - protein, 9 aa, HIV-1
IMMQRGNFR

SEQ ID NO: 3438 - protein, 15 aa, HIV-1
TPGIRYQYNVLPQGW

SEQ ID NO: 3439 - protein, 9 aa, HIV-1
IRYQYNVLP

SEQ ID NO: 3440 - protein, 15 aa, HIV-1
TPGIRYQYNVLPQGW

SEQ ID NO: 3441 - protein, 9 aa, HIV-1
YQYNVLPQG

SEQ ID NO: 3442 - protein, 15 aa, HIV-1
TPPLVKLWYQLEKEP

SEQ ID NO: 3443 - protein, 9 aa, HIV-1
VKLWYQLEK

SEQ ID NO: 3444 - protein, 15 aa, HIV-1
TPQDLNTMLNTVGGH

SEQ ID NO: 3445 - protein, 9 aa, HIV-1
LNTMLNTVG

SEQ ID NO: 3446 - protein, 15 aa, HIV-1
TPVFAIKKKDSTKWR

SEQ ID NO: 3447 - protein, 9 aa, HIV-1
IKKKDSTKW

SEQ ID NO: 3448 - protein, 15 aa, HIV-1
TPVFAIKKKDSTKWR

SEQ ID NO: 3449 - protein, 9 aa, HIV-1
VFAIKKKDS

SEQ ID NO: 3450 - protein, 15 aa, HIV-1
TPVNIIGRNLLTQIG

SEQ ID NO: 3451 - protein, 9 aa, HIV-1
IGRNLLTQI

SEQ ID NO: 3452 - protein, 15 aa, HIV-1
TPVNIIGRNLLTQIG

SEQ ID NO: 3453 - protein, 9 aa, HIV-1
VNIIGRNLL

SEQ ID NO: 3454 - protein, 15 aa, HIV-1
TQDFWEVQLGIPHPA

SEQ ID NO: 3455 - protein, 9 aa, HIV-1
EVQLGIPHP

SEQ ID NO: 3456 - protein, 15 aa, HIV-1
TSTLQEQIGWMTNNP

SEQ ID NO: 3457 - protein, 9 aa, HIV-1
LQEQIGWMT

SEQ ID NO: 3458 - protein, 15 aa, HIV-1
TTESIVIWGKTPKFK

SEQ ID NO: 3459 - protein, 9 aa, HIV-1
IVIWGKTPK

SEQ ID NO: 3460 - protein, 15 aa, HIV-1
TTESIVIWGKTPKFK

SEQ ID NO: 3461 - protein, 9 aa, HIV-1
VIWGKTPKF

SEQ ID NO: 3462 - protein, 15 aa, HIV-1
TTSTLQEQIGWMTNN

SEQ ID NO: 3463 - protein, 9 aa, HIV-1
LQEQIGWMT

SEQ ID NO: 3464 - protein, 15 aa, HIV-1
TVGGHQAAMQMLKET

SEQ ID NO: 3465 - protein, 9 aa, HIV-1
VGGHQAAMQ

SEQ ID NO: 3466 - protein, 15 aa, HIV-1
TVLDVGDAYFSVPLD

SEQ ID NO: 3467 - protein, 9 aa, HIV-1
LDVGDAYFS

SEQ ID NO: 3468 - protein, 15 aa, HIV-1
TVLEEMSLPGRWKPK

SEQ ID NO: 3469 - protein, 9 aa, HIV-1
LEEMSLPGR

SEQ ID NO: 3470 - protein, 15 aa, HIV-1
TVLVGPTPVNIIGRN

SEQ ID NO: 3471 - protein, 9 aa, HIV-1
LVGPTPVNI

SEQ ID NO: 3472 - protein, 15 aa, HIV-1
TVNDIQKLVGKLNWA

SEQ ID NO: 3473 - protein, 9 aa, HIV-1
IQKLVGKLN

SEQ ID NO: 3474 - protein, 15 aa, HIV-1
TVPVKLKPGMDGPKV

SEQ ID NO: 3475 - protein, 9 aa, HIV-1
VKLKPGMDG

SEQ ID NO: 3476 - protein, 15 aa, HIV-1
TVRAACWWAGIKQEF

SEQ ID NO: 3477 - protein, 9 aa, HIV-1
VRAACWWAG

SEQ ID NO: 3478 - protein, 15 aa, HIV-1
TWETWWTEYWQATWI

SEQ ID NO: 3479 - protein, 9 aa, HIV-1
WETWWTEYW

SEQ ID NO: 3480 - protein, 15 aa, HIV-1
TWIPEWEFVNTPPLV

SEQ ID NO: 3481 - protein, 9 aa, HIV-1
WEFVNTPPL

SEQ ID NO: 3482 - protein, 15 aa, HIV-1
TWWTEYWQATWIPEW

SEQ ID NO: 3483 - protein, 9 aa, HIV-1
EYWQATWIP

SEQ ID NO: 3484 - protein, 15 aa, HIV-1
VDGAANRETKLGKAG

SEQ ID NO: 3485 - protein, 9 aa, HIV-1
VDGAANRET

SEQ ID NO: 3486 - protein, 15 aa, HIV-1
VDKLVSAGIRKVLFL

SEQ ID NO: 3487 - protein, 9 aa, HIV-1
LVSAGIRKV

SEQ ID NO: 3488 - protein, 15 aa, HIV-1
VDRFYKTLRAEQASQ

SEQ ID NO: 3489 - protein, 9 aa, HIV-1
DRFYKTLRA

SEQ ID NO: 3490 - protein, 15 aa, HIV-1
VDRFYKTLRAEQASQ

SEQ ID NO: 3491 - protein, 9 aa, HIV-1
FYKTLRAEQ

SEQ ID NO: 3492 - protein, 15 aa, HIV-1
VDRFYKTLRAEQASQ

SEQ ID NO: 3493 - protein, 9 aa, HIV-1
YKTLRAEQA

SEQ ID NO: 3494 - protein, 15 aa, HIV-1
VFAIKKKDSTKWRKL

SEQ ID NO: 3495 - protein, 9 aa, HIV-1
IKKKDSTKW

SEQ ID NO: 3496 - protein, 15 aa, HIV-1
VFIHNFKRKGGIGGY

SEQ ID NO: 3497 - protein, 9 aa, HIV-1
FKRKGGIGG

SEQ ID NO: 3498 - protein, 15 aa, HIV-1
VFIHNFKRKGGIGGY

SEQ ID NO: 3499 - protein, 9 aa, HIV-1
IHNFKRKGG

SEQ ID NO: 3500 - protein, 15 aa, HIV-1
VGAETFYVDGAANRE

SEQ ID NO: 3501 - protein, 9 aa, HIV-1
FYVDGAANR

SEQ ID NO: 3502 - protein, 15 aa, HIV-1
VGDAYFSVPLDEDFR

SEQ ID NO: 3503 - protein, 9 aa, HIV-1
YFSVPLDED

SEQ ID NO: 3504 - protein, 15 aa, HIV-1
VGEIYKRWIILGLNK

SEQ ID NO: 3505 - protein, 9 aa, HIV-1
YKRWIILGL

SEQ ID NO: 3506 - protein, 15 aa, HIV-1
VGGHQAAMQMLKETI

SEQ ID NO: 3507 - protein, 9 aa, HIV-1
VGGHQAAMQ

SEQ ID NO: 3508 - protein, 15 aa, HIV-1
VGKLNWASQIYPGIK

SEQ ID NO: 3509 - protein, 9 aa, HIV-1
KLNWASQIY

SEQ ID NO: 3510 - protein, 15 aa, HIV-1
VGPTPVNIIGRNLLT

SEQ ID NO: 3511 - protein, 9 aa, HIV-1
VNIIGRNLL

SEQ ID NO: 3512 - protein, 15 aa, HIV-1
VHAGPIAPGQMREPR

SEQ ID NO: 3513 - protein, 9 aa, HIV-1
VHAGPIAPG

SEQ ID NO: 3514 - protein, 15 aa, HIV-1
VHPVHAGPIAPGQMR

SEQ ID NO: 3515 - protein, 9 aa, HIV-1
VHAGPIAPG

SEQ ID NO: 3516 - protein, 15 aa, HIV-1
VHQAISPRTLNAWVK

SEQ ID NO: 3517 - protein, 9 aa, HIV-1
VHQAISPRT

SEQ ID NO: 3518 - protein, 15 aa, HIV-1
VILVAVHVASGYIEA

SEQ ID NO: 3519 - protein, 9 aa, HIV-1
LVAVHVASG

SEQ ID NO: 3520 - protein, 15 aa, HIV-1
VIPMFSALSEGATPQ

SEQ ID NO: 3521 - protein, 9 aa, HIV-1
MFSALSEGA

SEQ ID NO: 3522 - protein, 15 aa, HIV-1
VIPMFSALSEGATPQ

SEQ ID NO: 3523 - protein, 9 aa, HIV-1
VIPMFSALS

SEQ ID NO: 3524 - protein, 15 aa, HIV-1
VIYQYMDDLYVGSDL

SEQ ID NO: 3525 - protein, 9 aa, HIV-1
YQYMDDLYV

SEQ ID NO: 3526 - protein, 15 aa, HIV-1
VKLKPGMDGPKVKQW

SEQ ID NO: 3527 - protein, 9 aa, HIV-1
VKLKPGMDG

SEQ ID NO: 3528 - protein, 15 aa, HIV-1
VKLWYQLEKEPIVGA

SEQ ID NO: 3529 - protein, 9 aa, HIV-1
VKLWYQLEK

SEQ ID NO: 3530 - protein, 15 aa, HIV-1
VKNWMTETLLVQNAN

SEQ ID NO: 3531 - protein, 9 aa, HIV-1
NWMTETLLV

SEQ ID NO: 3532 - protein, 15 aa, HIV-1
VKNWMTETLLVQNAN

SEQ ID NO: 3533 - protein, 9 aa, HIV-1
WMTETLLVQ

SEQ ID NO: 3534 - protein, 15 aa, HIV-1
VKQWPLTEEKIKALV

SEQ ID NO: 3535 - protein, 9 aa, HIV-1
VKQWPLTEE

SEQ ID NO: 3536 - protein, 15 aa, HIV-1
VLAEAMSQVTNSATI

SEQ ID NO: 3537 - protein, 9 aa, HIV-1
AMSQVTNSA

SEQ ID NO: 3538 - protein, 15 aa, HIV-1
VLAEAMSQVTNSATI

SEQ ID NO: 3539 - protein, 9 aa, HIV-1
LAEAMSQVT

SEQ ID NO: 3540 - protein, 15 aa, HIV-1
VLEEMSLPGRWKPKM

SEQ ID NO: 3541 - protein, 9 aa, HIV-1
LEEMSLPGR

SEQ ID NO: 3542 - protein, 15 aa, HIV-1
VLPQGWKGSPAIFQS

SEQ ID NO: 3543 - protein, 9 aa, HIV-1
WKGSPAIFQ

SEQ ID NO: 3544 - protein, 15 aa, HIV-1
VLVGPTPVNIIGRNL

SEQ ID NO: 3545 - protein, 9 aa, HIV-1
LVGPTPVNI

SEQ ID NO: 3546 - protein, 15 aa, HIV-1
VNDIQKLVGKLNWAS

SEQ ID NO: 3547 - protein, 9 aa, HIV-1
IQKLVGKLN

SEQ ID NO: 3548 - protein, 15 aa, HIV-1
VNDIQKLVGKLNWAS

SEQ ID NO: 3549 - protein, 9 aa, HIV-1
KLVGKLNWA

SEQ ID NO: 3550 - protein, 15 aa, HIV-1
VNIIGRNLLTQIGCT

SEQ ID NO: 3551 - protein, 9 aa, HIV-1
GRNLLTQIG

SEQ ID NO: 3552 - protein, 15 aa, HIV-1
VNIIGRNLLTQIGCT

SEQ ID NO: 3553 - protein, 9 aa, HIV-1
VNIIGRNLL

SEQ ID NO: 3554 - protein, 15 aa, HIV-1
VNTPPLVKLWYQLEK

SEQ ID NO: 3555 - protein, 9 aa, HIV-1
LVKLWYQLE

SEQ ID NO: 3556 - protein, 15 aa, HIV-1
VNTPPLVKLWYQLEK

SEQ ID NO: 3557 - protein, 9 aa, HIV-1
VNTPPLVKL

SEQ ID NO: 3558 - protein, 15 aa, HIV-1
VPLDEDFRKYTAFTI

SEQ ID NO: 3559 - protein, 9 aa, HIV-1
DFRKYTAFT

SEQ ID NO: 3560 - protein, 15 aa, HIV-1
VPVKLKPGMDGPKVK

SEQ ID NO: 3561 - protein, 9 aa, HIV-1
VKLKPGMDG

SEQ ID NO: 3562 - protein, 15 aa, HIV-1
VQKITTESIVIWGKT

SEQ ID NO: 3563 - protein, 9 aa, HIV-1
VQKITTESI

SEQ ID NO: 3564 - protein, 15 aa, HIV-1
VQLGIPHPAGLKKKK

SEQ ID NO: 3565 - protein, 9 aa, HIV-1
VQLGIPHPA

SEQ ID NO: 3566 - protein, 15 aa, HIV-1
VQMAVFIHNFKRKGG

SEQ ID NO: 3567 - protein, 9 aa, HIV-1
FIHNFKRKG

SEQ ID NO: 3568 - protein, 15 aa, HIV-1
VQMAVFIHNFKRKGG

SEQ ID NO: 3569 - protein, 9 aa, HIV-1
MAVFIHNFK

SEQ ID NO: 3570 - protein, 15 aa, HIV-1
VQMAVFIHNFKRKGG

SEQ ID NO: 3571 - protein, 9 aa, HIV-1
VFIHNFKRK

SEQ ID NO: 3572 - protein, 15 aa, HIV-1
VQNIQGQMVHQAISP

SEQ ID NO: 3573 - protein, 9 aa, HIV-1
IQGQMVHQA

SEQ ID NO: 3574 - protein, 15 aa, HIV-1
VRMYSPTSILDIRQG

SEQ ID NO: 3575 - protein, 9 aa, HIV-1
MYSPTSILD

SEQ ID NO: 3576 - protein, 15 aa, HIV-1
VRMYSPTSILDIRQG

SEQ ID NO: 3577 - protein, 9 aa, HIV-1
VRMYSPTSI

SEQ ID NO: 3578 - protein, 15 aa, HIV-1
VRMYSPTSILDIRQG

SEQ ID NO: 3579 - protein, 9 aa, HIV-1
YSPTSILDI

SEQ ID NO: 3580 - protein, 15 aa, HIV-1
VRQLCKLLRGTKALT

SEQ ID NO: 3581 - protein, 9 aa, HIV-1
CKLLRGTKA

SEQ ID NO: 3582 - protein, 15 aa, HIV-1
VRQLCKLLRGTKALT

SEQ ID NO: 3583 - protein, 9 aa, HIV-1
VRQLCKLLR

SEQ ID NO: 3584 - protein, 15 aa, HIV-1
VRAACWWAGIKQEFG

SEQ ID NO: 3585 - protein, 9 aa, HIV-1
VRAACWWAG

SEQ ID NO: 3586 - protein, 15 aa, HIV-1
VTDSQYALGIIQAQP

SEQ ID NO: 3587 - protein, 9 aa, HIV-1
YALGIIQAQ

SEQ ID NO: 3588 - protein, 15 aa, HIV-1
VTLWQRPLVTIKIGG

SEQ ID NO: 3589 - protein, 9 aa, HIV-1
LWQRPLVTI

SEQ ID NO: 3590 - protein, 15 aa, HIV-1
VTNRGRQKVVTLTDT

SEQ ID NO: 3591 - protein, 9 aa, HIV-1
VTNRGRQKV

SEQ ID NO: 3592 - protein, 15 aa, HIV-1
VTNSATIMMQRGNFR

SEQ ID NO: 3593 - protein, 9 aa, HIV-1
SATIMMQRG

SEQ ID NO: 3594 - protein, 15 aa, HIV-1
VTNSATIMMQRGNFR

SEQ ID NO: 3595 - protein, 9 aa, HIV-1
VTNSATIMM

SEQ ID NO: 3596 - protein, 15 aa, HIV-1
VTVLDVGDAYFSVPL

SEQ ID NO: 3597 - protein, 9 aa, HIV-1
LDVGDAYFS

SEQ ID NO: 3598 - protein, 15 aa, HIV-1
VVAKEIVASCDKCQL

SEQ ID NO: 3599 - protein, 9 aa, HIV-1
VVAKEIVAS

SEQ ID NO: 3600 - protein, 15 aa, HIV-1
VYLAWVPAHKGIGGN

SEQ ID NO: 3601 - protein, 9 aa, HIV-1
LAWVPAHKG

SEQ ID NO: 3602 - protein, 15 aa, HIV-1
VYLAWVPAHKGIGGN

SEQ ID NO: 3603 - protein, 9 aa, HIV-1
WVPAHKGIG

SEQ ID NO: 3604 - protein, 15 aa, HIV-1
VYLAWVPAHKGIGGN

SEQ ID NO: 3605 - protein, 9 aa, HIV-1
YLAWVPAHK

SEQ ID NO: 3606 - protein, 15 aa, HIV-1
VYYRDSRNPLWKGPA

SEQ ID NO: 3607 - protein, 9 aa, HIV-1
YRDSRNPLW

SEQ ID NO: 3608 - protein, 15 aa, HIV-1
WASQIYPGIKVRQLC

SEQ ID NO: 3609 - protein, 9 aa, HIV-1
YPGIKVRQL

SEQ ID NO: 3610 - protein, 15 aa, HIV-1
WDRVHPVHAGPIAPG

SEQ ID NO: 3611 - protein, 9 aa, HIV-1
VHPVHAGPI

SEQ ID NO: 3612 - protein, 15 aa, HIV-1
WEFVNTPPLVKLWYQ

SEQ ID NO: 3613 - protein, 9 aa, HIV-1
FVNTPPLVK

SEQ ID NO: 3614 - protein, 15 aa, HIV-1
WEFVNTPPLVKLWYQ

SEQ ID NO: 3615 - protein, 9 aa, HIV-1
VNTPPLVKL

SEQ ID NO: 3616 - protein, 15 aa, HIV-1
WEFVNTPPLVKLWYQ

SEQ ID NO: 3617 - protein, 9 aa, HIV-1
WEFVNTPPL

SEQ ID NO: 3618 - protein, 15 aa, HIV-1
WETWWTEYWQATWIP

SEQ ID NO: 3619 - protein, 9 aa, HIV-1
WETWWTEYW

SEQ ID NO: 3620 - protein, 15 aa, HIV-1
WETWWTEYWQATWIP

SEQ ID NO: 3621 - protein, 9 aa, HIV-1
WWTEYWQAT

SEQ ID NO: 3622 - protein, 15 aa, HIV-1
WEVQLGIPHPAGLKK

SEQ ID NO: 3623 - protein, 9 aa, HIV-1
VQLGIPHPA

SEQ ID NO: 3624 - protein, 15 aa, HIV-1
WIILGLNKIVRMYSP

SEQ ID NO: 3625 - protein, 9 aa, HIV-1
ILGLNKIVR

SEQ ID NO: 3626 - protein, 15 aa, HIV-1
WIILGLNKIVRMYSP

SEQ ID NO: 3627 - protein, 9 aa, HIV-1
LGLNKIVRM

SEQ ID NO: 3628 - protein, 15 aa, HIV-1
WIILGLNKIVRMYSP

SEQ ID NO: 3629 - protein, 9 aa, HIV-1
LNKIVRMYS

SEQ ID NO: 3630 - protein, 15 aa, HIV-1
WIILGLNKIVRMYSP

SEQ ID NO: 3631 - protein, 9 aa, HIV-1
WIILGLNKI

SEQ ID NO: 3632 - protein, 15 aa, HIV-1
WIPEWEFVNTPPLVK

SEQ ID NO: 3633 - protein, 9 aa, HIV-1
EFVNTPPLV

SEQ ID NO: 3634 - protein, 15 aa, HIV-1
WIPEWEFVNTPPLVK

SEQ ID NO: 3635 - protein, 9 aa, HIV-1
WEFVNTPPL

SEQ ID NO: 3636 - protein, 15 aa, HIV-1
WKGEGAVVIQDNSDI

SEQ ID NO: 3637 - protein, 9 aa, HIV-1
WKGEGAVVI

SEQ ID NO: 3638 - protein, 15 aa, HIV-1
WKGSPAIFQSSMTKI

SEQ ID NO: 3639 - protein, 9 aa, HIV-1
WKGSPAIFQ

SEQ ID NO: 3640 - protein, 15 aa, HIV-1
WMTNNPPIPVGEIYK

SEQ ID NO: 3641 - protein, 9 aa, HIV-1
MTNNPPIPV

SEQ ID NO: 3642 - protein, 15 aa, HIV-1
WPVKTIHTDNGSNFT

SEQ ID NO: 3643 - protein, 9 aa, HIV-1
VKTIHTDNG

SEQ ID NO: 3644 - protein, 15 aa, HIV-1
WQATWIPEWEFVNTP

SEQ ID NO: 3645 - protein, 9 aa, HIV-1
ATWIPEWEF

SEQ ID NO: 3646 - protein, 15 aa, HIV-1
WRAMASDFNLPPVVA

SEQ ID NO: 3647 - protein, 9 aa, HIV-1
MASDFNLPP

SEQ ID NO: 3648 - protein, 15 aa, HIV-1
WRAMASDFNLPPVVA

SEQ ID NO: 3649 - protein, 9 aa, HIV-1
WRAMASDFN

SEQ ID NO: 3650 - protein, 15 aa, HIV-1
WRKLVDFRELNKRTQ

SEQ ID NO: 3651 - protein, 9 aa, HIV-1
VDFRELNKR

SEQ ID NO: 3652 - protein, 15 aa, HIV-1
WTEYWQATWIPEWEF

SEQ ID NO: 3653 - protein, 9 aa, HIV-1
WQATWIPEW

SEQ ID NO: 3654 - protein, 15 aa, HIV-1
WTVNDIQKLVGKLNW

SEQ ID NO: 3655 - protein, 9 aa, HIV-1
IQKLVGKLN

SEQ ID NO: 3656 - protein, 15 aa, HIV-1
WTVQPIVLPEKDSWT

SEQ ID NO: 3657 - protein, 9 aa, HIV-1
WTVQPIVLP

SEQ ID NO: 3658 - protein, 15 aa, HIV-1
WWTEYWQATWIPEWE

SEQ ID NO: 3659 - protein, 9 aa, HIV-1
EYWQATWIP

SEQ ID NO: 3660 - protein, 15 aa, HIV-1
YALGIIQAQPDQSES

SEQ ID NO: 3661 - protein, 9 aa, HIV-1
IIQAQPDQS

SEQ ID NO: 3662 - protein, 15 aa, HIV-1
YALGIIQAQPDQSES

SEQ ID NO: 3663 - protein, 9 aa, HIV-1
IQAQPDQSE

SEQ ID NO: 3664 - protein, 15 aa, HIV-1
YARMRGAHTNDVKQL

SEQ ID NO: 3665 - protein, 9 aa, HIV-1
MRGAHTNDV

SEQ ID NO: 3666 - protein, 15 aa, HIV-1
YFLLKLAGRWPVKTI

SEQ ID NO: 3667 - protein, 9 aa, HIV-1
LAGRWPVKT

SEQ ID NO: 3668 - protein, 15 aa, HIV-1
YFLLKLAGRWPVKTI

SEQ ID NO: 3669 - protein, 9 aa, HIV-1
LKLAGRWPV

SEQ ID NO: 3670 - protein, 15 aa, HIV-1
YFLLKLAGRWPVKTI

SEQ ID NO: 3671 - protein, 9 aa, HIV-1
YFLLKLAGR

SEQ ID NO: 3672 - protein, 15 aa, HIV-1
YHSNWRAMASDFNLP

SEQ ID NO: 3673 - protein, 9 aa, HIV-1
WRAMASDFN

SEQ ID NO: 3674 - protein, 15 aa, HIV-1
YIEAEVIPAETGQET

SEQ ID NO: 3675 - protein, 9 aa, HIV-1
AEVIPAETG

SEQ ID NO: 3676 - protein, 15 aa, HIV-1
YKLKHIVWASRELER

SEQ ID NO: 3677 - protein, 9 aa, HIV-1
LKHIVWASR

SEQ ID NO: 3678 - protein, 15 aa, HIV-1
YKRWIILGLNKIVRM

SEQ ID NO: 3679 - protein, 9 aa, HIV-1
ILGLNKIVR

SEQ ID NO: 3680 - protein, 15 aa, HIV-1
YKRWIILGLNKIVRM

SEQ ID NO: 3681 - protein, 9 aa, HIV-1
WIILGLNKI

SEQ ID NO: 3682 - protein, 15 aa, HIV-1
YKTLRAEQASQEVKN

SEQ ID NO: 3683 - protein, 9 aa, HIV-1
YKTLRAEQA

SEQ ID NO: 3684 - protein, 15 aa, HIV-1
YLALQDSGLEVNIVT

SEQ ID NO: 3685 - protein, 9 aa, HIV-1
LQDSGLEVN

SEQ ID NO: 3686 - protein, 15 aa, HIV-1
YLAWVPAHKGIGGNE

SEQ ID NO: 3687 - protein, 9 aa, HIV-1
LAWVPAHKG

SEQ ID NO: 3688 - protein, 15 aa, HIV-1
YLAWVPAHKGIGGNE

SEQ ID NO: 3689 - protein, 9 aa, HIV-1
YLAWVPAHK

SEQ ID NO: 3690 - protein, 15 aa, HIV-1
YMDDLYVGSDLEIGQ

SEQ ID NO: 3691 - protein, 9 aa, HIV-1
YVGSDLEIG

SEQ ID NO: 3692 - protein, 15 aa, HIV-1
YNTVATLYCVHQRIE

SEQ ID NO: 3693 - protein, 9 aa, HIV-1
YNTVATLYC

SEQ ID NO: 3694 - protein, 15 aa, HIV-1
YPGIKVRQLCKLLRG

SEQ ID NO: 3695 - protein, 9 aa, HIV-1
VRQLCKLLR

SEQ ID NO: 3696 - protein, 15 aa, HIV-1
YPGIKVRQLCKLLRG

SEQ ID NO: 3697 - protein, 9 aa, HIV-1
YPGIKVRQL

SEQ ID NO: 3698 - protein, 15 aa, HIV-1
YPIVQNIQGQMVHQA

SEQ ID NO: 3699 - protein, 9 aa, HIV-1
VQNIQGQMV

SEQ ID NO: 3700 - protein, 15 aa, HIV-1
YQEPFKNLKTGKYAR

SEQ ID NO: 3701 - protein, 9 aa, HIV-1
FKNLKTGKY

SEQ ID NO: 3702 - protein, 15 aa, HIV-1
YSAGERIVDIIATDI

SEQ ID NO: 3703 - protein, 9 aa, HIV-1
ERIVDIIAT

SEQ ID NO: 3704 - protein, 15 aa, HIV-1
YVDGAANRETKLGKA

SEQ ID NO: 3705 - protein, 9 aa, HIV-1
YVDGAANRE

SEQ ID NO: 3706 - protein, 15 aa, HIV-1
YVDRFYKTLRAEQAS

SEQ ID NO: 3707 - protein, 9 aa, HIV-1
DRFYKTLRA

SEQ ID NO: 3708 - protein, 15 aa, HIV-1
YVDRFYKTLRAEQAS

SEQ ID NO: 3709 - protein, 9 aa, HIV-1
FYKTLRAEQ

SEQ ID NO: 3710 - protein, 15 aa, HIV-1
YVDRFYKTLRAEQAS

SEQ ID NO: 3711 - protein, 9 aa, HIV-1
YKTLRAEQA

SEQ ID NO: 3712 - protein, 15 aa, HIV-1
YWQATWIPEWEFVNT

SEQ ID NO: 3713 - protein, 9 aa, HIV-1
ATWIPEWEF

SEQ ID NO: 3714 - protein, 15 aa, HIV-1
AATLEEMMTACQGVG

SEQ ID NO: 3715 - protein, 9 aa, HIV-1
LEEMMTACQ

SEQ ID NO: 3716 - protein, 8 aa, HIV-1
MGARASVL

SEQ ID NO: 3717 - protein, 8 aa, HIV-1
SVLSGGEL

SEQ ID NO: 3718 - protein, 8 aa, HIV-1
ELDRWEKI

SEQ ID NO: 3719 - protein, 8 aa, HIV-1
RWEKIRLR

SEQ ID NO: 3720 - protein, 8 aa, HIV-1
RLRPGGKK

SEQ ID NO: 3721 - protein, 8 aa, HIV-1
KLKHIVWA

SEQ ID NO: 3722 - protein, 8 aa, HIV-1
IVWASREL

SEQ ID NO: 3723 - protein, 8 aa, HIV-1
WASRELER

SEQ ID NO: 3724 - protein, 8 aa, HIV-1
RELERFAV

SEQ ID NO: 3725 - protein, 8 aa, HIV-1
FAVNPGLL

SEQ ID NO: 3726 - protein, 8 aa, HIV-1
SEGCRQIL

SEQ ID NO: 3727 - protein, 8 aa, HIV-1
QLQPSLQT

SEQ ID NO: 3728 - protein, 8 aa, HIV-1
LQTGSEEL

SEQ ID NO: 3729 - protein, 8 aa, HIV-1
QTGSEELR

SEQ ID NO: 3730 - protein, 8 aa, HIV-1
SLYNTVAT

SEQ ID NO: 3731 - protein, 8 aa, HIV-1
LYNTVATL

SEQ ID NO: 3732 - protein, 8 aa, HIV-1
YNTVATLY

SEQ ID NO: 3733 - protein, 8 aa, HIV-1
TVATLYCV

SEQ ID NO: 3734 - protein, 8 aa, HIV-1
TLYCVHQR

SEQ ID NO: 3735 - protein, 8 aa, HIV-1
LYCVHQRI

SEQ ID NO: 3736 - protein, 8 aa, HIV-1
DTKEALDK

SEQ ID NO: 3737 - protein, 8 aa, HIV-1
KIEEEQNK

SEQ ID NO: 3738 - protein, 8 aa, HIV-1
DTGHSNQV

SEQ ID NO: 3739 - protein, 8 aa, HIV-1
QVSQNYPI

SEQ ID NO: 3740 - protein, 8 aa, HIV-1
NYPIVQNI

SEQ ID NO: 3741 - protein, 8 aa, HIV-1
YPIVQNIQ

SEQ ID NO: 3742 - protein, 8 aa, HIV-1
GQMVHQAI

SEQ ID NO: 3743 - protein, 8 aa, HIV-1
SPRTLNAW

SEQ ID NO: 3744 - protein, 8 aa, HIV-1
RTLNAWVK

SEQ ID NO: 3745 - protein, 8 aa, HIV-1
TLNAWVKV

SEQ ID NO: 3746 - protein, 8 aa, HIV-1
WVKVVEEK

SEQ ID NO: 3747 - protein, 8 aa, HIV-1
KVVEEKAF

SEQ ID NO: 3748 - protein, 8 aa, HIV-1
EKAFSPEV

SEQ ID NO: 3749 - protein, 8 aa, HIV-1
FSPEVIPM

SEQ ID NO: 3750 - protein, 8 aa, HIV-1
SPEVIPMF

SEQ ID NO: 3751 - protein, 8 aa, HIV-1
EVIPMFSA

SEQ ID NO: 3752 - protein, 8 aa, HIV-1
VIPMFSAL

SEQ ID NO: 3753 - protein, 8 aa, HIV-1
IPMFSALS

SEQ ID NO: 3754 - protein, 8 aa, HIV-1
FSALSEGA

SEQ ID NO: 3755 - protein, 8 aa, HIV-1
ALSEGATP

SEQ ID NO: 3756 - protein, 8 aa, HIV-1
TPQDLNTM

SEQ ID NO: 3757 - protein, 8 aa, HIV-1
NTVGGHQA

SEQ ID NO: 3758 - protein, 8 aa, HIV-1
TVGGHQAA

SEQ ID NO: 3759 - protein, 8 aa, HIV-1
HQAAMQML

SEQ ID NO: 3760 - protein, 8 aa, HIV-1
QAAMQMLK

SEQ ID NO: 3761 - protein, 8 aa, HIV-1
MQMLKETI

SEQ ID NO: 3762 - protein, 8 aa, HIV-1
ETINEEAA

SEQ ID NO: 3763 - protein, 8 aa, HIV-1
EEAAEWDR

SEQ ID NO: 3764 - protein, 8 aa, HIV-1
EAAEWDRV

SEQ ID NO: 3765 - protein, 8 aa, HIV-1
EWDRVHPV

SEQ ID NO: 3766 - protein, 8 aa, HIV-1
HPVHAGPI

SEQ ID NO: 3767 - protein, 8 aa, HIV-1
GPIAPGQM

SEQ ID NO: 3768 - protein, 8 aa, HIV-1
WMTNNPPI

SEQ ID NO: 3769 - protein, 8 aa, HIV-1
TNNPPIPV

SEQ ID NO: 3770 - protein, 8 aa, HIV-1
PPIPVGEI

SEQ ID NO: 3771 - protein, 8 aa, HIV-1
PIPVGEIY

SEQ ID NO: 3772 - protein, 8 aa, HIV-1
GEIYKRWI

SEQ ID NO: 3773 - protein, 8 aa, HIV-1
EIYKRWII

SEQ ID NO: 3774 - protein, 8 aa, HIV-1
IYKRWIIL

SEQ ID NO: 3775 - protein, 8 aa, HIV-1
KRWIILGL

SEQ ID NO: 3776 - protein, 8 aa, HIV-1
WIILGLNK

SEQ ID NO: 3777 - protein, 8 aa, HIV-1
IILGLNKI

SEQ ID NO: 3778 - protein, 8 aa, HIV-1
ILGLNKIV

SEQ ID NO: 3779 - protein, 8 aa, HIV-1
LGLNKIVR

SEQ ID NO: 3780 - protein, 8 aa, HIV-1
GLNKIVRM

SEQ ID NO: 3781 - protein, 8 aa, HIV-1
IVRMYSPT

SEQ ID NO: 3782 - protein, 8 aa, HIV-1
RMYSPTSI

SEQ ID NO: 3783 - protein, 8 aa, HIV-1
MYSPTSIL

SEQ ID NO: 3784 - protein, 8 aa, HIV-1
SPTSILDI

SEQ ID NO: 3785 - protein, 8 aa, HIV-1
RQGPKEPF

SEQ ID NO: 3786 - protein, 8 aa, HIV-1
DYVDRFYK

SEQ ID NO: 3787 - protein, 8 aa, HIV-1
YVDRFYKT

SEQ ID NO: 3788 - protein, 8 aa, HIV-1
DRFYKTLR

SEQ ID NO: 3789 - protein, 8 aa, HIV-1
AEQASQEV

SEQ ID NO: 3790 - protein, 8 aa, HIV-1
EQASQEVK

SEQ ID NO: 3791 - protein, 8 aa, HIV-1
ASQEVKNW

SEQ ID NO: 3792 - protein, 8 aa, HIV-1
EVKNWMTE

SEQ ID NO: 3793 - protein, 8 aa, HIV-1
NWMTETLL

SEQ ID NO: 3794 - protein, 8 aa, HIV-1
WMTETLLV

SEQ ID NO: 3795 - protein, 8 aa, HIV-1
ETLLVQNA

SEQ ID NO: 3796 - protein, 8 aa, HIV-1
NPDCKTIL

SEQ ID NO: 3797 - protein, 8 aa, HIV-1
ILKALGPA

SEQ ID NO: 3798 - protein, 8 aa, HIV-1
ALGPAATL

SEQ ID NO: 3799 - protein, 8 aa, HIV-1
TLEEMMTA

SEQ ID NO: 3800 - protein, 8 aa, HIV-1
EEMMTACQ

SEQ ID NO: 3801 - protein, 8 aa, HIV-1
MMTACQGV

SEQ ID NO: 3802 - protein, 8 aa, HIV-1
GVGGPGHK

SEQ ID NO: 3803 - protein, 8 aa, HIV-1
VLAEAMSQ

SEQ ID NO: 3804 - protein, 8 aa, HIV-1
AEAMSQVT

SEQ ID NO: 3805 - protein, 8 aa, HIV-1
SQVTNSAT

SEQ ID NO: 3806 - protein, 8 aa, HIV-1
VTNSATIM

SEQ ID NO: 3807 - protein, 8 aa, HIV-1
SATIMMQR

SEQ ID NO: 3808 - protein, 8 aa, HIV-1
IMMQRGNF

SEQ ID NO: 3809 - protein, 8 aa, HIV-1
MMQRGNFR

SEQ ID NO: 3810 - protein, 8 aa, HIV-1
RGNFRNQR

SEQ ID NO: 3811 - protein, 8 aa, HIV-1
RNQRKIVK

SEQ ID NO: 3812 - protein, 8 aa, HIV-1
HTARNCRA

SEQ ID NO: 3813 - protein, 8 aa, HIV-1
RNCRAPRK

SEQ ID NO: 3814 - protein, 8 aa, HIV-1
NCRAPRKK

SEQ ID NO: 3815 - protein, 8 aa, HIV-1
APRKKGCW

SEQ ID NO: 3816 - protein, 8 aa, HIV-1
QMKDCTER

SEQ ID NO: 3817 - protein, 8 aa, HIV-1
CTERQANF

SEQ ID NO: 3818 - protein, 8 aa, HIV-1
TERQANFL

SEQ ID NO: 3819 - protein, 8 aa, HIV-1
RQANFLGK

SEQ ID NO: 3820 - protein, 8 aa, HIV-1
FLGKIWPS

SEQ ID NO: 3821 - protein, 8 aa, HIV-1
KGRPGNFL

SEQ ID NO: 3822 - protein, 8 aa, HIV-1
TAPPEESF

SEQ ID NO: 3823 - protein, 8 aa, HIV-1
EESFRSGV

SEQ ID NO: 3824 - protein, 8 aa, HIV-1
ETTTPPQK

SEQ ID NO: 3825 - protein, 8 aa, HIV-1
QEPIDKEL

SEQ ID NO: 3826 - protein, 8 aa, HIV-1
EPIDKELY

SEQ ID NO: 3827 - protein, 8 aa, HIV-1
ELYPLTSL

SEQ ID NO: 3828 - protein, 8 aa, HIV-1
LYPLTSLR

SEQ ID NO: 3829 - protein, 8 aa, HIV-1
PLTSLRSL

SEQ ID NO: 3830 - protein, 8 aa, HIV-1
SLFGNDPS

SEQ ID NO: 3831 - protein, 9 aa, HIV-1
VLSGGELDR

SEQ ID NO: 3832 - protein, 9 aa, HIV-1
LSGGELDRW

SEQ ID NO: 3833 - protein, 9 aa, HIV-1
DRWEKIRLR

SEQ ID NO: 3834 - protein, 9 aa, HIV-1
KIRLRPGGK

SEQ ID NO: 3835 - protein, 9 aa, HIV-1
RLRPGGKKK

SEQ ID NO: 3836 - protein, 9 aa, HIV-1
GGKKKYKLK

SEQ ID NO: 3837 - protein, 9 aa, HIV-1
KKYKLKHIV

SEQ ID NO: 3838 - protein, 9 aa, HIV-1
KYKLKHIVW

SEQ ID NO: 3839 - protein, 9 aa, HIV-1
KLKHIVWAS

SEQ ID NO: 3840 - protein, 9 aa, HIV-1
HIVWASREL

SEQ ID NO: 3841 - protein, 9 aa, HIV-1
WASRELERF

SEQ ID NO: 3842 - protein, 9 aa, HIV-1
ERFAVNPGL

SEQ ID NO: 3843 - protein, 9 aa, HIV-1
RFAVNPGLL

SEQ ID NO: 3844 - protein, 9 aa, HIV-1
AVNPGLLET

SEQ ID NO: 3845 - protein, 9 aa, HIV-1
GLLETSEGC

SEQ ID NO: 3846 - protein, 9 aa, HIV-1
ETSEGCRQI

SEQ ID NO: 3847 - protein, 9 aa, HIV-1
ILGQLQPSL

SEQ ID NO: 3848 - protein, 9 aa, HIV-1
GQLQPSLQT

SEQ ID NO: 3849 - protein, 9 aa, HIV-1
SLQTGSEEL

SEQ ID NO: 3850 - protein, 9 aa, HIV-1
LQTGSEELR

SEQ ID NO: 3851 - protein, 9 aa, HIV-1
GSEELRSLY

SEQ ID NO: 3852 - protein, 9 aa, HIV-1
ELRSLYNTV

SEQ ID NO: 3853 - protein, 9 aa, HIV-1
SLYNTVATL

SEQ ID NO: 3854 - protein, 9 aa, HIV-1
LYNTVATLY

SEQ ID NO: 3855 - protein, 9 aa, HIV-1
NTVATLYCV

SEQ ID NO: 3856 - protein, 9 aa, HIV-1
ATLYCVHQR

SEQ ID NO: 3857 - protein, 9 aa, HIV-1
TLYCVHQRI

SEQ ID NO: 3858 - protein, 9 aa, HIV-1
YCVHQRIEI

SEQ ID NO: 3859 - protein, 9 aa, HIV-1
CVHQRIEIK

SEQ ID NO: 3860 - protein, 9 aa, HIV-1
QRIEIKDTK

SEQ ID NO: 3861 - protein, 9 aa, HIV-1
EIKDTKEAL

SEQ ID NO: 3862 - protein, 9 aa, HIV-1
ALDKIEEEQ

SEQ ID NO: 3863 - protein, 9 aa, HIV-1
QQAAADTGH

SEQ ID NO: 3864 - protein, 9 aa, HIV-1
HSNQVSQNY

SEQ ID NO: 3865 - protein, 9 aa, HIV-1
NQVSQNYPI

SEQ ID NO: 3866 - protein, 9 aa, HIV-1
QVSQNYPIV

SEQ ID NO: 3867 - protein, 9 aa, HIV-1
QNYPIVQNI

SEQ ID NO: 3868 - protein, 9 aa, HIV-1
VQNIQGQMV

SEQ ID NO: 3869 - protein, 9 aa, HIV-1
IQGQMVHQA

SEQ ID NO: 3870 - protein, 9 aa, HIV-1
MVHQAISPR

SEQ ID NO: 3871 - protein, 9 aa, HIV-1
HQAISPRTL

SEQ ID NO: 3872 - protein, 9 aa, HIV-1
AISPRTLNA

SEQ ID NO: 3873 - protein, 9 aa, HIV-1
ISPRTLNAW

SEQ ID NO: 3874 - protein, 9 aa, HIV-1
SPRTLNAWV

SEQ ID NO: 3875 - protein, 9 aa, HIV-1
RTLNAWVKV

SEQ ID NO: 3876 - protein, 9 aa, HIV-1
TLNAWVKVV

SEQ ID NO: 3877 - protein, 9 aa, HIV-1
AWVKVVEEK

SEQ ID NO: 3878 - protein, 9 aa, HIV-1
EEKAFSPEV

SEQ ID NO: 3879 - protein, 9 aa, HIV-1
EKAFSPEVI

SEQ ID NO: 3880 - protein, 9 aa, HIV-1
FSPEVIPMF

SEQ ID NO: 3881 - protein, 9 aa, HIV-1
EVIPMFSAL

SEQ ID NO: 3882 - protein, 9 aa, HIV-1
IPMFSALSE

SEQ ID NO: 3883 - protein, 9 aa, HIV-1
ALSEGATPQ

SEQ ID NO: 3884 - protein, 9 aa, HIV-1
SEGATPQDL

SEQ ID NO: 3885 - protein, 9 aa, HIV-1
ATPQDLNTM

SEQ ID NO: 3886 - protein, 9 aa, HIV-1
TPQDLNTML

SEQ ID NO: 3887 - protein, 9 aa, HIV-1
DLNTMLNTV

SEQ ID NO: 3888 - protein, 9 aa, HIV-1
NTVGGHQAA

SEQ ID NO: 3889 - protein, 9 aa, HIV-1
TVGGHQAAM

SEQ ID NO: 3890 - protein, 9 aa, HIV-1
HQAAMQMLK

SEQ ID NO: 3891 - protein, 9 aa, HIV-1
AMQMLKETI

SEQ ID NO: 3892 - protein, 9 aa, HIV-1
ETINEEAAE

SEQ ID NO: 3893 - protein, 9 aa, HIV-1
TINEEAAEW

SEQ ID NO: 3894 - protein, 9 aa, HIV-1
EEAAEWDRV

SEQ ID NO: 3895 - protein, 9 aa, HIV-1
EAAEWDRVH

SEQ ID NO: 3896 - protein, 9 aa, HIV-1
AEWDRVHPV

SEQ ID NO: 3897 - protein, 9 aa, HIV-1
RVHPVHAGP

SEQ ID NO: 3898 - protein, 9 aa, HIV-1
HPVHAGPIA

SEQ ID NO: 3899 - protein, 9 aa, HIV-1
DIAGTTSTL

SEQ ID NO: 3900 - protein, 9 aa, HIV-1
TTSTLQEQI

SEQ ID NO: 3901 - protein, 9 aa, HIV-1
STLQEQIGW

SEQ ID NO: 3902 - protein, 9 aa, HIV-1
TLQEQIGWM

SEQ ID NO: 3903 - protein, 9 aa, HIV-1
GWMTNNPPI

SEQ ID NO: 3904 - protein, 9 aa, HIV-1
MTNNPPIPV

SEQ ID NO: 3905 - protein, 9 aa, HIV-1
NPPIPVGEI

SEQ ID NO: 3906 - protein, 9 aa, HIV-1
PPIPVGEIY

SEQ ID NO: 3907 - protein, 9 aa, HIV-1
IPVGEIYKR

SEQ ID NO: 3908 - protein, 9 aa, HIV-1
GEIYKRWII

SEQ ID NO: 3909 - protein, 9 aa, HIV-1
EIYKRWIIL

SEQ ID NO: 3910 - protein, 9 aa, HIV-1
YKRWIILGL

SEQ ID NO: 3911 - protein, 9 aa, HIV-1
RWIILGLNK

SEQ ID NO: 3912 - protein, 9 aa, HIV-1
WIILGLNKI

SEQ ID NO: 3913 - protein, 9 aa, HIV-1
IILGLNKIV

SEQ ID NO: 3914 - protein, 9 aa, HIV-1
GLNKIVRMY

SEQ ID NO: 3915 - protein, 9 aa, HIV-1
KIVRMYSPT

SEQ ID NO: 3916 - protein, 9 aa, HIV-1
IVRMYSPTS

SEQ ID NO: 3917 - protein, 9 aa, HIV-1
RMYSPTSIL

SEQ ID NO: 3918 - protein, 9 aa, HIV-1
SPTSILDIR

SEQ ID NO: 3919 - protein, 9 aa, HIV-1
SILDIRQGP

SEQ ID NO: 3920 - protein, 9 aa, HIV-1
ILDIRQGPK

SEQ ID NO: 3921 - protein, 9 aa, HIV-1
RQGPKEPFR

SEQ ID NO: 3922 - protein, 9 aa, HIV-1
EPFRDYVDR

SEQ ID NO: 3923 - protein, 9 aa, HIV-1
PFRDYVDRF

SEQ ID NO: 3924 - protein, 9 aa, HIV-1
RDYVDRFYK

SEQ ID NO: 3925 - protein, 9 aa, HIV-1
DYVDRFYKT

SEQ ID NO: 3926 - protein, 9 aa, HIV-1
YVDRFYKTL

SEQ ID NO: 3927 - protein, 9 aa, HIV-1
VDRFYKTLR

SEQ ID NO: 3928 - protein, 9 aa, HIV-1
RAEQASQEV

SEQ ID NO: 3929 - protein, 9 aa, HIV-1
QASQEVKNW

SEQ ID NO: 3930 - protein, 9 aa, HIV-1
EVKNWMTET

SEQ ID NO: 3931 - protein, 9 aa, HIV-1
NWMTETLLV

SEQ ID NO: 3932 - protein, 9 aa, HIV-1
WMTETLLVQ

SEQ ID NO: 3933 - protein, 9 aa, HIV-1
VQNANPDCK

SEQ ID NO: 3934 - protein, 9 aa, HIV-1
TILKALGPA

SEQ ID NO: 3935 - protein, 9 aa, HIV-1
ILKALGPAA

SEQ ID NO: 3936 - protein, 9 aa, HIV-1
KALGPAATL

SEQ ID NO: 3937 - protein, 9 aa, HIV-1
GPAATLEEM

SEQ ID NO: 3938 - protein, 9 aa, HIV-1
ATLEEMMTA

SEQ ID NO: 3939 - protein, 9 aa, HIV-1
TLEEMMTAC

SEQ ID NO: 3940 - protein, 9 aa, HIV-1
EEMMTACQG

SEQ ID NO: 3941 - protein, 9 aa, HIV-1
EMMTACQGV

SEQ ID NO: 3942 - protein, 9 aa, HIV-1
GVGGPGHKA

SEQ ID NO: 3943 - protein, 9 aa, HIV-1
GGPGHKARV

SEQ ID NO: 3944 - protein, 9 aa, HIV-1
GPGHKARVL

SEQ ID NO: 3945 - protein, 9 aa, HIV-1
KARVLAEAM

SEQ ID NO: 3946 - protein, 9 aa, HIV-1
VLAEAMSQV

SEQ ID NO: 3947 - protein, 9 aa, HIV-1
LAEAMSQVT

SEQ ID NO: 3948 - protein, 9 aa, HIV-1
AEAMSQVTN

SEQ ID NO: 3949 - protein, 9 aa, HIV-1
AMSQVTNSA

SEQ ID NO: 3950 - protein, 9 aa, HIV-1
SQVTNSATI

SEQ ID NO: 3951 - protein, 9 aa, HIV-1
QVTNSATIM

SEQ ID NO: 3952 - protein, 9 aa, HIV-1
VTNSATIMM

SEQ ID NO: 3953 - protein, 9 aa, HIV-1
NSATIMMQR

SEQ ID NO: 3954 - protein, 9 aa, HIV-1
IMMQRGNFR

SEQ ID NO: 3955 - protein, 9 aa, HIV-1
MMQRGNFRN

SEQ ID NO: 3956 - protein, 9 aa, HIV-1
RGNFRNQRK

SEQ ID NO: 3957 - protein, 9 aa, HIV-1
FRNQRKIVK

SEQ ID NO: 3958 - protein, 9 aa, HIV-1
NQRKIVKCF

SEQ ID NO: 3959 - protein, 9 aa, HIV-1
IVKCFNCGK

SEQ ID NO: 3960 - protein, 9 aa, HIV-1
EGHTARNCR

SEQ ID NO: 3961 - protein, 9 aa, HIV-1
TARNCRAPR

SEQ ID NO: 3962 - protein, 9 aa, HIV-1
ARNCRAPRK

SEQ ID NO: 3963 - protein, 9 aa, HIV-1
RNCRAPRKK

SEQ ID NO: 3964 - protein, 9 aa, HIV-1
APRKKGCWK

SEQ ID NO: 3965 - protein, 9 aa, HIV-1
HQMKDCTER

SEQ ID NO: 3966 - protein, 9 aa, HIV-1
RQANFLGKI

SEQ ID NO: 3967 - protein, 9 aa, HIV-1
QANFLGKIW

SEQ ID NO: 3968 - protein, 9 aa, HIV-1
FLGKIWPSY

SEQ ID NO: 3969 - protein, 9 aa, HIV-1
KIWPSYKGR

SEQ ID NO: 3970 - protein, 9 aa, HIV-1
WPSYKGRPG

SEQ ID NO: 3971 - protein, 9 aa, HIV-1
SYKGRPGNF

SEQ ID NO: 3972 - protein, 9 aa, HIV-1
KGRPGNFLQ

SEQ ID NO: 3973 - protein, 9 aa, HIV-1
FLQSRPEPT

SEQ ID NO: 3974 - protein, 9 aa, HIV-1
PTAPPEESF

SEQ ID NO: 3975 - protein, 9 aa, HIV-1
TAPPEESFR

SEQ ID NO: 3976 - protein, 9 aa, HIV-1
TPPQKQEPI

SEQ ID NO: 3977 - protein, 9 aa, HIV-1
PIDKELYPL

SEQ ID NO: 3978 - protein, 9 aa, HIV-1
KELYPLTSL

SEQ ID NO: 3979 - protein, 9 aa, HIV-1
ELYPLTSLR

SEQ ID NO: 3980 - protein, 9 aa, HIV-1
YPLTSLRSL

SEQ ID NO: 3981 - protein, 9 aa, HIV-1
SLFGNDPSS

SEQ ID NO: 3982 - protein, 10 aa, HIV-1
RASVLSGGEL

SEQ ID NO: 3983 - protein, 10 aa, HIV-1
SVLSGGELDR

SEQ ID NO: 3984 - protein, 10 aa, HIV-1
VLSGGELDRW

SEQ ID NO: 3985 - protein, 10 aa, HIV-1
ELDRWEKIRL

SEQ ID NO: 3986 - protein, 10 aa, HIV-1
KIRLRPGGKK

SEQ ID NO: 3987 - protein, 10 aa, HIV-1
RLRPGGKKKY

SEQ ID NO: 3988 - protein, 10 aa, HIV-1
RPGGKKKYKL

SEQ ID NO: 3989 - protein, 10 aa, HIV-1
KKYKLKHIVW

SEQ ID NO: 3990 - protein, 10 aa, HIV-1
KLKHIVWASR

SEQ ID NO: 3991 - protein, 10 aa, HIV-1
IVWASRELER

SEQ ID NO: 3992 - protein, 10 aa, HIV-1
VWASRELERF

SEQ ID NO: 3993 - protein, 10 aa, HIV-1
LERFAVNPGL

SEQ ID NO: 3994 - protein, 10 aa, HIV-1
ERFAVNPGLL

SEQ ID NO: 3995 - protein, 10 aa, HIV-1
FAVNPGLLET

SEQ ID NO: 3996 - protein, 10 aa, HIV-1
ETSEGCRQIL

SEQ ID NO: 3997 - protein, 10 aa, HIV-1
RQILGQLQPS

SEQ ID NO: 3998 - protein, 10 aa, HIV-1
QILGQLQPSL

SEQ ID NO: 3999 - protein, 10 aa, HIV-1
ILGQLQPSLQ

SEQ ID NO: 4000 - protein, 10 aa, HIV-1
SLQTGSEELR

SEQ ID NO: 4001 - protein, 10 aa, HIV-1
EELRSLYNTV

SEQ ID NO: 4002 - protein, 10 aa, HIV-1
RSLYNTVATL

SEQ ID NO: 4003 - protein, 10 aa, HIV-1
SLYNTVATLY

SEQ ID NO: 4004 - protein, 10 aa, HIV-1
VATLYCVHQR

SEQ ID NO: 4005 - protein, 10 aa, HIV-1
ATLYCVHQRI

SEQ ID NO: 4006 - protein, 10 aa, HIV-1
LYCVHQRIEI

SEQ ID NO: 4007 - protein, 10 aa, HIV-1
IEIKDTKEAL

SEQ ID NO: 4008 - protein, 10 aa, HIV-1
AADTGHSNQV

SEQ ID NO: 4009 - protein, 10 aa, HIV-1
NQVSQNYPIV

SEQ ID NO: 4010 - protein, 10 aa, HIV-1
SQNYPIVQNI

SEQ ID NO: 4011 - protein, 10 aa, HIV-1
PIVQNIQGQM

SEQ ID NO: 4012 - protein, 10 aa, HIV-1
IVQNIQGQMV

SEQ ID NO: 4013 - protein, 10 aa, HIV-1
VQNIQGQMVH

SEQ ID NO: 4014 - protein, 10 aa, HIV-1
NIQGQMVHQA

SEQ ID NO: 4015 - protein, 10 aa, HIV-1
IQGQMVHQAI

SEQ ID NO: 4016 - protein, 10 aa, HIV-1
QMVHQAISPR

SEQ ID NO: 4017 - protein, 10 aa, HIV-1
AISPRTLNAW

SEQ ID NO: 4018 - protein, 10 aa, HIV-1
RTLNAWVKVV

SEQ ID NO: 4019 - protein, 10 aa, HIV-1
NAWVKVVEEK

SEQ ID NO: 4020 - protein, 10 aa, HIV-1
WVKVVEEKAF

SEQ ID NO: 4021 - protein, 10 aa, HIV-1
VEEKAFSPEV

SEQ ID NO: 4022 - protein, 10 aa, HIV-1
EEKAFSPEVI

SEQ ID NO: 4023 - protein, 10 aa, HIV-1
KAFSPEVIPM

SEQ ID NO: 4024 - protein, 10 aa, HIV-1
AFSPEVIPMF

SEQ ID NO: 4025 - protein, 10 aa, HIV-1
PEVIPMFSAL

SEQ ID NO: 4026 - protein, 10 aa, HIV-1
EVIPMFSALS

SEQ ID NO: 4027 - protein, 10 aa, HIV-1
PMFSALSEGA

SEQ ID NO: 4028 - protein, 10 aa, HIV-1
ATPQDLNTML

SEQ ID NO: 4029 - protein, 10 aa, HIV-1
MLNTVGGHQA

SEQ ID NO: 4030 - protein, 10 aa, HIV-1
NTVGGHQAAM

SEQ ID NO: 4031 - protein, 10 aa, HIV-1
GHQAAMQMLK

SEQ ID NO: 4032 - protein, 10 aa, HIV-1
AAMQMLKETI

SEQ ID NO: 4033 - protein, 10 aa, HIV-1
MLKETINEEA

SEQ ID NO: 4034 - protein, 10 aa, HIV-1
ETINEEAAEW

SEQ ID NO: 4035 - protein, 10 aa, HIV-1
AAEWDRVHPV

SEQ ID NO: 4036 - protein, 10 aa, HIV-1
RVHPVHAGPI

SEQ ID NO: 4037 - protein, 10 aa, HIV-1
HPVHAGPIAP

SEQ ID NO: 4038 - protein, 10 aa, HIV-1
IAPGQMREPR

SEQ ID NO: 4039 - protein, 10 aa, HIV-1
TSTLQEQIGW

SEQ ID NO: 4040 - protein, 10 aa, HIV-1
STLQEQIGWM

SEQ ID NO: 4041 - protein, 10 aa, HIV-1
TLQEQIGWMT

SEQ ID NO: 4042 - protein, 10 aa, HIV-1
WMTNNPPIPV

SEQ ID NO: 4043 - protein, 10 aa, HIV-1
NPPIPVGEIY

SEQ ID NO: 4044 - protein, 10 aa, HIV-1
IPVGEIYKRW

SEQ ID NO: 4045 - protein, 10 aa, HIV-1
GEIYKRWIIL

SEQ ID NO: 4046 - protein, 10 aa, HIV-1
IYKRWIILGL

SEQ ID NO: 4047 - protein, 10 aa, HIV-1
KRWIILGLNK

SEQ ID NO: 4048 - protein, 10 aa, HIV-1
RWIILGLNKI

SEQ ID NO: 4049 - protein, 10 aa, HIV-1
WIILGLNKIV

SEQ ID NO: 4050 - protein, 10 aa, HIV-1
IILGLNKIVR

SEQ ID NO: 4051 - protein, 10 aa, HIV-1
ILGLNKIVRM

SEQ ID NO: 4052 - protein, 10 aa, HIV-1
IVRMYSPTSI

SEQ ID NO: 4053 - protein, 10 aa, HIV-1
MYSPTSILDI

SEQ ID NO: 4054 - protein, 10 aa, HIV-1
YSPTSILDIR

SEQ ID NO: 4055 - protein, 10 aa, HIV-1
SILDIRQGPK

SEQ ID NO: 4056 - protein, 10 aa, HIV-1
DIRQGPKEPF

SEQ ID NO: 4057 - protein, 10 aa, HIV-1
EPFRDYVDRF

SEQ ID NO: 4058 - protein, 10 aa, HIV-1
DYVDRFYKTL

SEQ ID NO: 4059 - protein, 10 aa, HIV-1
YVDRFYKTLR

SEQ ID NO: 4060 - protein, 10 aa, HIV-1
RFYKTLRAEQ

SEQ ID NO: 4061 - protein, 10 aa, HIV-1
RAEQASQEVK

SEQ ID NO: 4062 - protein, 10 aa, HIV-1
EVKNWMTETL

SEQ ID NO: 4063 - protein, 10 aa, HIV-1
WMTETLLVQN

SEQ ID NO: 4064 - protein, 10 aa, HIV-1
LVQNANPDCK

SEQ ID NO: 4065 - protein, 10 aa, HIV-1
KTILKALGPA

SEQ ID NO: 4066 - protein, 10 aa, HIV-1
TILKALGPAA

SEQ ID NO: 4067 - protein, 10 aa, HIV-1
ILKALGPAAT

SEQ ID NO: 4068 - protein, 10 aa, HIV-1
GPAATLEEMM

SEQ ID NO: 4069 - protein, 10 aa, HIV-1
ATLEEMMTAC

SEQ ID NO: 4070 - protein, 10 aa, HIV-1
TLEEMMTACQ

SEQ ID NO: 4071 - protein, 10 aa, HIV-1
EEMMTACQGV

SEQ ID NO: 4072 - protein, 10 aa, HIV-1
VGGPGHKARV

SEQ ID NO: 4073 - protein, 10 aa, HIV-1
RVLAEAMSQV

SEQ ID NO: 4074 - protein, 10 aa, HIV-1
VLAEAMSQVT

SEQ ID NO: 4075 - protein, 10 aa, HIV-1
AEAMSQVTNS

SEQ ID NO: 4076 - protein, 10 aa, HIV-1
EAMSQVTNSA

SEQ ID NO: 4077 - protein, 10 aa, HIV-1
AMSQVTNSAT

SEQ ID NO: 4078 - protein, 10 aa, HIV-1
SQVTNSATIM

SEQ ID NO: 4079 - protein, 10 aa, HIV-1
QVTNSATIMM

SEQ ID NO: 4080 - protein, 10 aa, HIV-1
TNSATIMMQR

SEQ ID NO: 4081 - protein, 10 aa, HIV-1
ATIMMQRGNF

SEQ ID NO: 4082 - protein, 10 aa, HIV-1
TIMMQRGNFR

SEQ ID NO: 4083 - protein, 10 aa, HIV-1
MMQRGNFRNQ

SEQ ID NO: 4084 - protein, 10 aa, HIV-1
MQRGNFRNQR

SEQ ID NO: 4085 - protein, 10 aa, HIV-1
NFRNQRKIVK

SEQ ID NO: 4086 - protein, 10 aa, HIV-1
KIVKCFNCGK

SEQ ID NO: 4087 - protein, 10 aa, HIV-1
KEGHTARNCR

SEQ ID NO: 4088 - protein, 10 aa, HIV-1
HTARNCRAPR

SEQ ID NO: 4089 - protein, 10 aa, HIV-1
TARNCRAPRK

SEQ ID NO: 4090 - protein, 10 aa, HIV-1
ARNCRAPRKK

SEQ ID NO: 4091 - protein, 10 aa, HIV-1
RAPRKKGCWK

SEQ ID NO: 4092 - protein, 10 aa, HIV-1
APRKKGCWKC

SEQ ID NO: 4093 - protein, 10 aa, HIV-1
RKKGCWKCGK

SEQ ID NO: 4094 - protein, 10 aa, HIV-1
KCGKEGHQMK

SEQ ID NO: 4095 - protein, 10 aa, HIV-1
QMKDCTERQA

SEQ ID NO: 4096 - protein, 10 aa, HIV-1
TERQANFLGK

SEQ ID NO: 4097 - protein, 10 aa, HIV-1
RQANFLGKIW

SEQ ID NO: 4098 - protein, 10 aa, HIV-1
FLGKIWPSYK

SEQ ID NO: 4099 - protein, 10 aa, HIV-1
SYKGRPGNFL

SEQ ID NO: 4100 - protein, 10 aa, HIV-1
FLQSRPEPTA

SEQ ID NO: 4101 - protein, 10 aa, HIV-1
EPTAPPEESF

SEQ ID NO: 4102 - protein, 10 aa, HIV-1
PTAPPEESFR

SEQ ID NO: 4103 - protein, 10 aa, HIV-1
EESFRSGVET

SEQ ID NO: 4104 - protein, 10 aa, HIV-1
GVETTTPPQK

SEQ ID NO: 4105 - protein, 10 aa, HIV-1
TTPPQKQEPI

SEQ ID NO: 4106 - protein, 10 aa, HIV-1
EPIDKELYPL

SEQ ID NO: 4107 - protein, 10 aa, HIV-1
ELYPLTSLRS

SEQ ID NO: 4108 - protein, 10 aa, HIV-1
LYPLTSLRSL

SEQ ID NO: 4109 - protein, 10 aa, HIV-1
YPLTSLRSLF

SEQ ID NO: 4110 - protein, 10 aa, HIV-1
SLFGNDPSSQ

SEQ ID NO: 4111 - protein, 11 aa, HIV-1
VLSGGELDRWE

SEQ ID NO: 4112 - protein, 11 aa, HIV-1
LSGGELDRWEK

SEQ ID NO: 4113 - protein, 11 aa, HIV-1
GELDRWEKIRL

SEQ ID NO: 4114 - protein, 11 aa, HIV-1
ELDRWEKIRLR

SEQ ID NO: 4115 - protein, 11 aa, HIV-1
KIRLRPGGKKK

SEQ ID NO: 4116 - protein, 11 aa, HIV-1
RLRPGGKKKYK

SEQ ID NO: 4117 - protein, 11 aa, HIV-1
HIVWASRELER

SEQ ID NO: 4118 - protein, 11 aa, HIV-1
WASRELERFAV

SEQ ID NO: 4119 - protein, 11 aa, HIV-1
ELERFAVNPGL

SEQ ID NO: 4120 - protein, 11 aa, HIV-1
LERFAVNPGLL

SEQ ID NO: 4121 - protein, 11 aa, HIV-1
GLLETSEGCRQ

SEQ ID NO: 4122 - protein, 11 aa, HIV-1
LLETSEGCRQI

SEQ ID NO: 4123 - protein, 11 aa, HIV-1
LETSEGCRQIL

SEQ ID NO: 4124 - protein, 11 aa, HIV-1
SEGCRQILGQL

SEQ ID NO: 4125 - protein, 11 aa, HIV-1
RQILGQLQPSL

SEQ ID NO: 4126 - protein, 11 aa, HIV-1
ILGQLQPSLQT

SEQ ID NO: 4127 - protein, 11 aa, HIV-1
QPSLQTGSEEL

SEQ ID NO: 4128 - protein, 11 aa, HIV-1
LQTGSEELRSL

SEQ ID NO: 4129 - protein, 11 aa, HIV-1
QTGSEELRSLY

SEQ ID NO: 4130 - protein, 11 aa, HIV-1
SEELRSLYNTV

SEQ ID NO: 4131 - protein, 11 aa, HIV-1
RSLYNTVATLY

SEQ ID NO: 4132 - protein, 11 aa, HIV-1
SLYNTVATLYC

SEQ ID NO: 4133 - protein, 11 aa, HIV-1
LYNTVATLYCV

SEQ ID NO: 4134 - protein, 11 aa, HIV-1
NTVATLYCVHQ

SEQ ID NO: 4135 - protein, 11 aa, HIV-1
TVATLYCVHQR

SEQ ID NO: 4136 - protein, 11 aa, HIV-1
TLYCVHQRIEI

SEQ ID NO: 4137 - protein, 11 aa, HIV-1
LYCVHQRIEIK

SEQ ID NO: 4138 - protein, 11 aa, HIV-1
EIKDTKEALDK

SEQ ID NO: 4139 - protein, 11 aa, HIV-1
ALDKIEEEQNK

SEQ ID NO: 4140 - protein, 11 aa, HIV-1
AAADTGHSNQV

SEQ ID NO: 4141 - protein, 11 aa, HIV-1
HSNQVSQNYPI

SEQ ID NO: 4142 - protein, 11 aa, HIV-1
YPIVQNIQGQM

SEQ ID NO: 4143 - protein, 11 aa, HIV-1
PIVQNIQGQMV

SEQ ID NO: 4144 - protein, 11 aa, HIV-1
NIQGQMVHQAI

SEQ ID NO: 4145 - protein, 11 aa, HIV-1
GQMVHQAISPR

SEQ ID NO: 4146 - protein, 11 aa, HIV-1
MVHQAISPRTL

SEQ ID NO: 4147 - protein, 11 aa, HIV-1
QAISPRTLNAW

SEQ ID NO: 4148 - protein, 11 aa, HIV-1
AISPRTLNAWV

SEQ ID NO: 4149 - protein, 11 aa, HIV-1
ISPRTLNAWVK

SEQ ID NO: 4150 - protein, 11 aa, HIV-1
SPRTLNAWVKV

SEQ ID NO: 4151 - protein, 11 aa, HIV-1
LNAWVKVVEEK

SEQ ID NO: 4152 - protein, 11 aa, HIV-1
AWVKVVEEKAF

SEQ ID NO: 4153 - protein, 11 aa, HIV-1
VVEEKAFSPEV

SEQ ID NO: 4154 - protein, 11 aa, HIV-1
KAFSPEVIPMF

SEQ ID NO: 4155 - protein, 11 aa, HIV-1
FSPEVIPMFSA

SEQ ID NO: 4156 - protein, 11 aa, HIV-1
SPEVIPMFSAL

SEQ ID NO: 4157 - protein, 11 aa, HIV-1
EVIPMFSALSE

SEQ ID NO: 4158 - protein, 11 aa, HIV-1
IPMFSALSEGA

SEQ ID NO: 4159 - protein, 11 aa, HIV-1
ALSEGATPQDL

SEQ ID NO: 4160 - protein, 11 aa, HIV-1
EGATPQDLNTM

SEQ ID NO: 4161 - protein, 11 aa, HIV-1
PQDLNTMLNTV

SEQ ID NO: 4162 - protein, 11 aa, HIV-1
TMLNTVGGHQA

SEQ ID NO: 4163 - protein, 11 aa, HIV-1
MLNTVGGHQAA

SEQ ID NO: 4164 - protein, 11 aa, HIV-1
TVGGHQAAMQM

SEQ ID NO: 4165 - protein, 11 aa, HIV-1
GGHQAAMQMLK

SEQ ID NO: 4166 - protein, 11 aa, HIV-1
QAAMQMLKETI

SEQ ID NO: 4167 - protein, 11 aa, HIV-1
MQMLKETINEE

SEQ ID NO: 4168 - protein, 11 aa, HIV-1
QMLKETINEEA

SEQ ID NO: 4169 - protein, 11 aa, HIV-1
MLKETINEEAA

SEQ ID NO: 4170 - protein, 11 aa, HIV-1
TINEEAAEWDR

SEQ ID NO: 4171 - protein, 11 aa, HIV-1
EAAEWDRVHPV

SEQ ID NO: 4172 - protein, 11 aa, HIV-1
RVHPVHAGPIA

SEQ ID NO: 4173 - protein, 11 aa, HIV-1
HPVHAGPIAPG

SEQ ID NO: 4174 - protein, 11 aa, HIV-1
HAGPIAPGQMR

SEQ ID NO: 4175 - protein, 11 aa, HIV-1
TTSTLQEQIGW

SEQ ID NO: 4176 - protein, 11 aa, HIV-1
QIGWMTNNPPI

SEQ ID NO: 4177 - protein, 11 aa, HIV-1
IPVGEIYKRWI

SEQ ID NO: 4178 - protein, 11 aa, HIV-1
EIYKRWIILGL

SEQ ID NO: 4179 - protein, 11 aa, HIV-1
KRWIILGLNKI

SEQ ID NO: 4180 - protein, 11 aa, HIV-1
WIILGLNKIVR

SEQ ID NO: 4181 - protein, 11 aa, HIV-1
IILGLNKIVRM

SEQ ID NO: 4182 - protein, 11 aa, HIV-1
KIVRMYSPTSI

SEQ ID NO: 4183 - protein, 11 aa, HIV-1
IVRMYSPTSIL

SEQ ID NO: 4184 - protein, 11 aa, HIV-1
RMYSPTSILDI

SEQ ID NO: 4185 - protein, 11 aa, HIV-1
MYSPTSILDIR

SEQ ID NO: 4186 - protein, 11 aa, HIV-1
TSILDIRQGPK

SEQ ID NO: 4187 - protein, 11 aa, HIV-1
DIRQGPKEPFR

SEQ ID NO: 4188 - protein, 11 aa, HIV-1
RQGPKEPFRDY

SEQ ID NO: 4189 - protein, 11 aa, HIV-1
QGPKEPFRDYV

SEQ ID NO: 4190 - protein, 11 aa, HIV-1
EPFRDYVDRFY

SEQ ID NO: 4191 - protein, 11 aa, HIV-1
PFRDYVDRFYK

SEQ ID NO: 4192 - protein, 11 aa, HIV-1
DYVDRFYKTLR

SEQ ID NO: 4193 - protein, 11 aa, HIV-1
YVDRFYKTLRA

SEQ ID NO: 4194 - protein, 11 aa, HIV-1
TLRAEQASQEV

SEQ ID NO: 4195 - protein, 11 aa, HIV-1
AEQASQEVKNW

SEQ ID NO: 4196 - protein, 11 aa, HIV-1
QEVKNWMTETL

SEQ ID NO: 4197 - protein, 11 aa, HIV-1
EVKNWMTETLL

SEQ ID NO: 4198 - protein, 11 aa, HIV-1
WMTETLLVQNA

SEQ ID NO: 4199 - protein, 11 aa, HIV-1
LLVQNANPDCK

SEQ ID NO: 4200 - protein, 11 aa, HIV-1
NANPDCKTILK

SEQ ID NO: 4201 - protein, 11 aa, HIV-1
NPDCKTILKAL

SEQ ID NO: 4202 - protein, 11 aa, HIV-1
KTILKALGPAA

SEQ ID NO: 4203 - protein, 11 aa, HIV-1
ILKALGPAATL

SEQ ID NO: 4204 - protein, 11 aa, HIV-1
ALGPAATLEEM

SEQ ID NO: 4205 - protein, 11 aa, HIV-1
EEMMTACQGVG

SEQ ID NO: 4206 - protein, 11 aa, HIV-1
MTACQGVGGPG

SEQ ID NO: 4207 - protein, 11 aa, HIV-1
ACQGVGGPGHK

SEQ ID NO: 4208 - protein, 11 aa, HIV-1
GVGGPGHKARV

SEQ ID NO: 4209 - protein, 11 aa, HIV-1
KARVLAEAMSQ

SEQ ID NO: 4210 - protein, 11 aa, HIV-1
AEAMSQVTNSA

SEQ ID NO: 4211 - protein, 11 aa, HIV-1
EAMSQVTNSAT

SEQ ID NO: 4212 - protein, 11 aa, HIV-1
AMSQVTNSATI

SEQ ID NO: 4213 - protein, 11 aa, HIV-1
MSQVTNSATIM

SEQ ID NO: 4214 - protein, 11 aa, HIV-1
SQVTNSATIMM

SEQ ID NO: 4215 - protein, 11 aa, HIV-1
VTNSATIMMQR

SEQ ID NO: 4216 - protein, 11 aa, HIV-1
ATIMMQRGNFR

SEQ ID NO: 4217 - protein, 11 aa, HIV-1
MMQRGNFRNQR

SEQ ID NO: 4218 - protein, 11 aa, HIV-1
MQRGNFRNQRK

SEQ ID NO: 4219 - protein, 11 aa, HIV-1
FRNQRKIVKCF

SEQ ID NO: 4220 - protein, 11 aa, HIV-1
HTARNCRAPRK

SEQ ID NO: 4221 - protein, 11 aa, HIV-1
TARNCRAPRKK

SEQ ID NO: 4222 - protein, 11 aa, HIV-1
EGHQMKDCTER

SEQ ID NO: 4223 - protein, 11 aa, HIV-1
CTERQANFLGK

SEQ ID NO: 4224 - protein, 11 aa, HIV-1
TERQANFLGKI

SEQ ID NO: 4225 - protein, 11 aa, HIV-1
NFLGKIWPSYK

SEQ ID NO: 4226 - protein, 11 aa, HIV-1
WPSYKGRPGNF

SEQ ID NO: 4227 - protein, 11 aa, HIV-1
KGRPGNFLQSR

SEQ ID NO: 4228 - protein, 11 aa, HIV-1
EPTAPPEESFR

SEQ ID NO: 4229 - protein, 11 aa, HIV-1
RSGVETTTPPQ

SEQ ID NO: 4230 - protein, 11 aa, HIV-1
SGVETTTPPQK

SEQ ID NO: 4231 - protein, 11 aa, HIV-1
TTTPPQKQEPI

SEQ ID NO: 4232 - protein, 11 aa, HIV-1
QEPIDKELYPL

SEQ ID NO: 4233 - protein, 11 aa, HIV-1
EPIDKELYPLT

SEQ ID NO: 4234 - protein, 11 aa, HIV-1
DKELYPLTSLR

SEQ ID NO: 4235 - protein, 11 aa, HIV-1
ELYPLTSLRSL

SEQ ID NO: 4236 - protein, 11 aa, HIV-1
LYPLTSLRSLF

SEQ ID NO: 4237 - protein, 15 aa, HIV-1
AEAMSQVTNSATIMM

SEQ ID NO: 4238 - protein, 9 aa, HIV-1
AMSQVTNSA

SEQ ID NO: 4239 - protein, 15 aa, HIV-1
AEAMSQVTNSATIMM

SEQ ID NO: 4240 - protein, 9 aa, HIV-1
MSQVTNSAT

SEQ ID NO: 4241 - protein, 15 aa, HIV-1
AEAMSQVTNSATIMM

SEQ ID NO: 4242 - protein, 9 aa, HIV-1
QVTNSATIM

SEQ ID NO: 4243 - protein, 15 aa, HIV-1
AFSPEVIPMFSALSE

SEQ ID NO: 4244 - protein, 9 aa, HIV-1
VIPMFSALS

SEQ ID NO: 4245 - protein, 15 aa, HIV-1
AGPIAPGQMREPRGS

SEQ ID NO: 4246 - protein, 9 aa, HIV-1
IAPGQMREP

SEQ ID NO: 4247 - protein, 15 aa, HIV-1
AISPRTLNAWVKVVE

SEQ ID NO: 4248 - protein, 9 aa, HIV-1
PRTLNAWVK

SEQ ID NO: 4249 - protein, 15 aa, HIV-1
AISPRTLNAWVKVVE

SEQ ID NO: 4250 - protein, 9 aa, HIV-1
TLNAWVKVV

SEQ ID NO: 4251 - protein, 15 aa, HIV-1
AMSQVTNSATIMMQR

SEQ ID NO: 4252 - protein, 9 aa, HIV-1
AMSQVTNSA

SEQ ID NO: 4253 - protein, 15 aa, HIV-1
AMSQVTNSATIMMQR

SEQ ID NO: 4254 - protein, 9 aa, HIV-1
VTNSATIMM

SEQ ID NO: 4255 - protein, 15 aa, HIV-1
ANFLGKIWPSYKGRP

SEQ ID NO: 4256 - protein, 9 aa, HIV-1
FLGKIWPSY

SEQ ID NO: 4257 - protein, 15 aa, HIV-1
ANFLGKIWPSYKGRP

SEQ ID NO: 4258 - protein, 9 aa, HIV-1
GKIWPSYKG

SEQ ID NO: 4259 - protein, 15 aa, HIV-1
ANFLGKIWPSYKGRP

SEQ ID NO: 4260 - protein, 9 aa, HIV-1
LGKIWPSYK

SEQ ID NO: 4261 - protein, 15 aa, HIV-1
APPEESFRSGVETTT

SEQ ID NO: 4262 - protein, 9 aa, HIV-1
SFRSGVETT

SEQ ID NO: 4263 - protein, 15 aa, HIV-1
ARVLAEAMSQVTNSA

SEQ ID NO: 4264 - protein, 9 aa, HIV-1
LAEAMSQVT

SEQ ID NO: 4265 - protein, 15 aa, HIV-1
ARVLAEAMSQVTNSA

SEQ ID NO: 4266 - protein, 9 aa, HIV-1
VLAEAMSQV

SEQ ID NO: 4267 - protein, 15 aa, HIV-1
ASQEVKNWMTETLLV

SEQ ID NO: 4268 - protein, 9 aa, HIV-1
VKNWMTETL

SEQ ID NO: 4269 - protein, 15 aa, HIV-1
ASRELERFAVNPGLL

SEQ ID NO: 4270 - protein, 9 aa, HIV-1
LERFAVNPG

SEQ ID NO: 4271 - protein, 15 aa, HIV-1
ATIMMQRGNFRNQRK

SEQ ID NO: 4272 - protein, 9 aa, HIV-1
IMMQRGNFR

SEQ ID NO: 4273 - protein, 15 aa, HIV-1
ATLEEMMTACQGVGG

SEQ ID NO: 4274 - protein, 9 aa, HIV-1
LEEMMTACQ

SEQ ID NO: 4275 - protein, 15 aa, HIV-1
ATPQDLNTMLNTVGG

SEQ ID NO: 4276 - protein, 9 aa, HIV-1
LNTMLNTVG

SEQ ID NO: 4277 - protein, 15 aa, HIV-1
CKTILKALGPAATLE

SEQ ID NO: 4278 - protein, 9 aa, HIV-1
ILKALGPAA

SEQ ID NO: 4279 - protein, 15 aa, HIV-1
CKTILKALGPAATLE

SEQ ID NO: 4280 - protein, 9 aa, HIV-1
LKALGPAAT

SEQ ID NO: 4281 - protein, 15 aa, HIV-1
CRQILGQLQPSLQTG

SEQ ID NO: 4282 - protein, 9 aa, HIV-1
GQLQPSLQT

SEQ ID NO: 4283 - protein, 15 aa, HIV-1
CRQILGQLQPSLQTG

SEQ ID NO: 4284 - protein, 9 aa, HIV-1
LGQLQPSLQ

SEQ ID NO: 4285 - protein, 15 aa, HIV-1
DCKTILKALGPAATL

SEQ ID NO: 4286 - protein, 9 aa, HIV-1
ILKALGPAA

SEQ ID NO: 4287 - protein, 15 aa, HIV-1
DCKTILKALGPAATL

SEQ ID NO: 4288 - protein, 9 aa, HIV-1
LKALGPAAT

SEQ ID NO: 4289 - protein, 15 aa, HIV-1
DIAGTTSTLQEQIGW

SEQ ID NO: 4290 - protein, 9 aa, HIV-1
IAGTTSTLQ

SEQ ID NO: 4291 - protein, 15 aa, HIV-1
DKELYPLTSLRSLFG

SEQ ID NO: 4292 - protein, 9 aa, HIV-1
ELYPLTSLR

SEQ ID NO: 4293 - protein, 15 aa, HIV-1
DKELYPLTSLRSLFG

SEQ ID NO: 4294 - protein, 9 aa, HIV-1
LYPLTSLRS

SEQ ID NO: 4295 - protein, 15 aa, HIV-1
DLNTMLNTVGGHQAA

SEQ ID NO: 4296 - protein, 9 aa, HIV-1
LNTMLNTVG

SEQ ID NO: 4297 - protein, 15 aa, HIV-1
DLNTMLNTVGGHQAA

SEQ ID NO: 4298 - protein, 9 aa, HIV-1
MLNTVGGHQ

SEQ ID NO: 4299 - protein, 15 aa, HIV-1
DRFYKTLRAEQASQE

SEQ ID NO: 4300 - protein, 9 aa, HIV-1
DRFYKTLRA

SEQ ID NO: 4301 - protein, 15 aa, HIV-1
DRFYKTLRAEQASQE

SEQ ID NO: 4302 - protein, 9 aa, HIV-1
FYKTLRAEQ

SEQ ID NO: 4303 - protein, 15 aa, HIV-1
DRFYKTLRAEQASQE

SEQ ID NO: 4304 - protein, 9 aa, HIV-1
YKTLRAEQA

SEQ ID NO: 4305 - protein, 15 aa, HIV-1
DRVHPVHAGPIAPGQ

SEQ ID NO: 4306 - protein, 9 aa, HIV-1
VHAGPIAPG

SEQ ID NO: 4307 - protein, 15 aa, HIV-1
DYVDRFYKTLRAEQA

SEQ ID NO: 4308 - protein, 9 aa, HIV-1
DRFYKTLRA

SEQ ID NO: 4309 - protein, 15 aa, HIV-1
DYVDRFYKTLRAEQA

SEQ ID NO: 4310 - protein, 9 aa, HIV-1
FYKTLRAEQ

SEQ ID NO: 4311 - protein, 15 aa, HIV-1
DYVDRFYKTLRAEQA

SEQ ID NO: 4312 - protein, 9 aa, HIV-1
VDRFYKTLR

SEQ ID NO: 4313 - protein, 15 aa, HIV-1
DYVDRFYKTLRAEQA

SEQ ID NO: 4314 - protein, 9 aa, HIV-1
YVDRFYKTL

SEQ ID NO: 4315 - protein, 15 aa, HIV-1
EAMSQVTNSATIMMQ

SEQ ID NO: 4316 - protein, 9 aa, HIV-1
AMSQVTNSA

SEQ ID NO: 4317 - protein, 15 aa, HIV-1
EAMSQVTNSATIMMQ

SEQ ID NO: 4318 - protein, 9 aa, HIV-1
VTNSATIMM

SEQ ID NO: 4319 - protein, 15 aa, HIV-1
EELRSLYNTVATLYC

SEQ ID NO: 4320 - protein, 9 aa, HIV-1
LRSLYNTVA

SEQ ID NO: 4321 - protein, 15 aa, HIV-1
EELRSLYNTVATLYC

SEQ ID NO: 4322 - protein, 9 aa, HIV-1
LYNTVATLY

SEQ ID NO: 4323 - protein, 15 aa, HIV-1
EESFRSGVETTTPPQ

SEQ ID NO: 4324 - protein, 9 aa, HIV-1
FRSGVETTT

SEQ ID NO: 4325 - protein, 15 aa, HIV-1
EGCRQILGQLQPSLQ

SEQ ID NO: 4326 - protein, 9 aa, HIV-1
CRQILGQLQ

SEQ ID NO: 4327 - protein, 15 aa, HIV-1
EGCRQILGQLQPSLQ

SEQ ID NO: 4328 - protein, 9 aa, HIV-1
ILGQLQPSL

SEQ ID NO: 4329 - protein, 15 aa, HIV-1
EGCRQILGQLQPSLQ

SEQ ID NO: 4330 - protein, 9 aa, HIV-1
RQILGQLQP

SEQ ID NO: 4331 - protein, 15 aa, HIV-1
EIYKRWIILGLNKIV

SEQ ID NO: 4332 - protein, 9 aa, HIV-1
WIILGLNKI

SEQ ID NO: 4333 - protein, 15 aa, HIV-1
EIYKRWIILGLNKIV

SEQ ID NO: 4334 - protein, 9 aa, HIV-1
YKRWIILGL

SEQ ID NO: 4335 - protein, 15 aa, HIV-1
ELERFAVNPGLLETS

SEQ ID NO: 4336 - protein, 9 aa, HIV-1
FAVNPGLLE

SEQ ID NO: 4337 - protein, 15 aa, HIV-1
ELRSLYNTVATLYCV

SEQ ID NO: 4338 - protein, 9 aa, HIV-1
LYNTVATLY

SEQ ID NO: 4339 - protein, 15 aa, HIV-1
ELRSLYNTVATLYCV

SEQ ID NO: 4340 - protein, 9 aa, HIV-1
YNTVATLYC

SEQ ID NO: 4341 - protein, 15 aa, HIV-1
ELYPLTSLRSLFGND

SEQ ID NO: 4342 - protein, 9 aa, HIV-1
LTSLRSLFG

SEQ ID NO: 4343 - protein, 15 aa, HIV-1
ELYPLTSLRSLFGND

SEQ ID NO: 4344 - protein, 9 aa, HIV-1
LYPLTSLRS

SEQ ID NO: 4345 - protein, 15 aa, HIV-1
EPIDKELYPLTSLRS

SEQ ID NO: 4346 - protein, 9 aa, HIV-1
IDKELYPLT

SEQ ID NO: 4347 - protein, 15 aa, HIV-1
EPRGSDIAGTTSTLQ

SEQ ID NO: 4348 - protein, 9 aa, HIV-1
EPRGSDIAG

SEQ ID NO: 4349 - protein, 15 aa, HIV-1
EPRGSDIAGTTSTLQ

SEQ ID NO: 4350 - protein, 9 aa, HIV-1
GSDIAGTTS

SEQ ID NO: 4351 - protein, 15 aa, HIV-1
EPRGSDIAGTTSTLQ

SEQ ID NO: 4352 - protein, 9 aa, HIV-1
RGSDIAGTT

SEQ ID NO: 4353 - protein, 15 aa, HIV-1
EQASQEVKNWMTETL

SEQ ID NO: 4354 - protein, 9 aa, HIV-1
EVKNWMTET

SEQ ID NO: 4355 - protein, 15 aa, HIV-1
EQASQEVKNWMTETL

SEQ ID NO: 4356 - protein, 9 aa, HIV-1
SQEVKNWMT

SEQ ID NO: 4357 - protein, 15 aa, HIV-1
EQIGWMTNNPPIPVG

SEQ ID NO: 4358 - protein, 9 aa, HIV-1
IGWMTNNPP

SEQ ID NO: 4359 - protein, 15 aa, HIV-1
EQIGWMTNNPPIPVG

SEQ ID NO: 4360 - protein, 9 aa, HIV-1
MTNNPPIPV

SEQ ID NO: 4361 - protein, 15 aa, HIV-1
ERFAVNPGLLETSEG

SEQ ID NO: 4362 - protein, 9 aa, HIV-1
FAVNPGLLE

SEQ ID NO: 4363 - protein, 15 aa, HIV-1
ERFAVNPGLLETSEG

SEQ ID NO: 4364 - protein, 9 aa, HIV-1
VNPGLLETS

SEQ ID NO: 4365 - protein, 15 aa, HIV-1
ERQANFLGKIWPSYK

SEQ ID NO: 4366 - protein, 9 aa, HIV-1
FLGKIWPSY

SEQ ID NO: 4367 - protein, 15 aa, HIV-1
ESFRSGVETTTPPQK

SEQ ID NO: 4368 - protein, 9 aa, HIV-1
FRSGVETTT

SEQ ID NO: 4369 - protein, 15 aa, HIV-1
ETLLVQNANPDCKTI

SEQ ID NO: 4370 - protein, 9 aa, HIV-1
VQNANPDCK

SEQ ID NO: 4371 - protein, 15 aa, HIV-1
EVIPMFSALSEGATP

SEQ ID NO: 4372 - protein, 9 aa, HIV-1
IPMFSALSE

SEQ ID NO: 4373 - protein, 15 aa, HIV-1
EVIPMFSALSEGATP

SEQ ID NO: 4374 - protein, 9 aa, HIV-1
MFSALSEGA

SEQ ID NO: 4375 - protein, 15 aa, HIV-1
EVIPMFSALSEGATP

SEQ ID NO: 4376 - protein, 9 aa, HIV-1
VIPMFSALS

SEQ ID NO: 4377 - protein, 15 aa, HIV-1
EVKNWMTETLLVQNA

SEQ ID NO: 4378 - protein, 9 aa, HIV-1
NWMTETLLV

SEQ ID NO: 4379 - protein, 15 aa, HIV-1
EVKNWMTETLLVQNA

SEQ ID NO: 4380 - protein, 9 aa, HIV-1
WMTETLLVQ

SEQ ID NO: 4381 - protein, 15 aa, HIV-1
FAVNPGLLETSEGCR

SEQ ID NO: 4382 - protein, 9 aa, HIV-1
VNPGLLETS

SEQ ID NO: 4383 - protein, 15 aa, HIV-1
FLGKIWPSYKGRPGN

SEQ ID NO: 4384 - protein, 9 aa, HIV-1
FLGKIWPSY

SEQ ID NO: 4385 - protein, 15 aa, HIV-1
FLGKIWPSYKGRPGN

SEQ ID NO: 4386 - protein, 9 aa, HIV-1
GKIWPSYKG

SEQ ID NO: 4387 - protein, 15 aa, HIV-1
FLGKIWPSYKGRPGN

SEQ ID NO: 4388 - protein, 9 aa, HIV-1
LGKIWPSYK

SEQ ID NO: 4389 - protein, 15 aa, HIV-1
FLQSRPEPTAPPEES

SEQ ID NO: 4390 - protein, 9 aa, HIV-1
FLQSRPEPT

SEQ ID NO: 4391 - protein, 15 aa, HIV-1
FRNQRKIVKCFNCGK

SEQ ID NO: 4392 - protein, 9 aa, HIV-1
FRNQRKIVK

SEQ ID NO: 4393 - protein, 15 aa, HIV-1
FRSGVETTTPPQKQE

SEQ ID NO: 4394 - protein, 9 aa, HIV-1
VETTTPPQK

SEQ ID NO: 4395 - protein, 15 aa, HIV-1
FSPEVIPMFSALSEG

SEQ ID NO: 4396 - protein, 9 aa, HIV-1
VIPMFSALS

SEQ ID NO: 4397 - protein, 15 aa, HIV-1
FYKTLRAEQASQEVK

SEQ ID NO: 4398 - protein, 9 aa, HIV-1
FYKTLRAEQ

SEQ ID NO: 4399 - protein, 15 aa, HIV-1
FYKTLRAEQASQEVK

SEQ ID NO: 4400 - protein, 9 aa, HIV-1
YKTLRAEQA

SEQ ID NO: 4401 - protein, 15 aa, HIV-1
GATPQDLNTMLNTVG

SEQ ID NO: 4402 - protein, 9 aa, HIV-1
DLNTMLNTV

SEQ ID NO: 4403 - protein, 15 aa, HIV-1
GATPQDLNTMLNTVG

SEQ ID NO: 4404 - protein, 9 aa, HIV-1
PQDLNTMLN

SEQ ID NO: 4405 - protein, 15 aa, HIV-1
GCRQILGQLQPSLQT

SEQ ID NO: 4406 - protein, 9 aa, HIV-1
LGQLQPSLQ

SEQ ID NO: 4407 - protein, 15 aa, HIV-1
GEIYKRWIILGLNKI

SEQ ID NO: 4408 - protein, 9 aa, HIV-1
IYKRWIILG

SEQ ID NO: 4409 - protein, 15 aa, HIV-1
GEIYKRWIILGLNKI

SEQ ID NO: 4410 - protein, 9 aa, HIV-1
YKRWIILGL

SEQ ID NO: 4411 - protein, 15 aa, HIV-1
GGHQAAMQMLKETIN

SEQ ID NO: 4412 - protein, 9 aa, HIV-1
AAMQMLKET

SEQ ID NO: 4413 - protein, 15 aa, HIV-1
GHKARVLAEAMSQVT

SEQ ID NO: 4414 - protein, 9 aa, HIV-1
VLAEAMSQV

SEQ ID NO: 4415 - protein, 15 aa, HIV-1
GKIWPSYKGRPGNFL

SEQ ID NO: 4416 - protein, 9 aa, HIV-1
GKIWPSYKG

SEQ ID NO: 4417 - protein, 15 aa, HIV-1
GKKKYKLKHIVWASR

SEQ ID NO: 4418 - protein, 9 aa, HIV-1
YKLKHIVWA

SEQ ID NO: 4419 - protein, 15 aa, HIV-1
GLNKIVRMYSPTSIL

SEQ ID NO: 4420 - protein, 9 aa, HIV-1
IVRMYSPTS

SEQ ID NO: 4421 - protein, 15 aa, HIV-1
GLNKIVRMYSPTSIL

SEQ ID NO: 4422 - protein, 9 aa, HIV-1
LNKIVRMYS

SEQ ID NO: 4423 - protein, 15 aa, HIV-1
GLNKIVRMYSPTSIL

SEQ ID NO: 4424 - protein, 9 aa, HIV-1
VRMYSPTSI

SEQ ID NO: 4425 - protein, 15 aa, HIV-1
GNFLQSRPEPTAPPE

SEQ ID NO: 4426 - protein, 9 aa, HIV-1
FLQSRPEPT

SEQ ID NO: 4427 - protein, 15 aa, HIV-1
GNFRNQRKIVKCFNC

SEQ ID NO: 4428 - protein, 9 aa, HIV-1
FRNQRKIVK

SEQ ID NO: 4429 - protein, 15 aa, HIV-1
GPAATLEEMMTACQG

SEQ ID NO: 4430 - protein, 9 aa, HIV-1
LEEMMTACQ

SEQ ID NO: 4431 - protein, 15 aa, HIV-1
GQLQPSLQTGSEELR

SEQ ID NO: 4432 - protein, 9 aa, HIV-1
GQLQPSLQT

SEQ ID NO: 4433 - protein, 15 aa, HIV-1
GQMVHQAISPRTLNA

SEQ ID NO: 4434 - protein, 9 aa, HIV-1
MVHQAISPR

SEQ ID NO: 4435 - protein, 15 aa, HIV-1
GQMVHQAISPRTLNA

SEQ ID NO: 4436 - protein, 9 aa, HIV-1
VHQAISPRT

SEQ ID NO: 4437 - protein, 15 aa, HIV-1
GRPGNFLQSRPEPTA

SEQ ID NO: 4438 - protein, 9 aa, HIV-1
FLQSRPEPT

SEQ ID NO: 4439 - protein, 15 aa, HIV-1
GSDIAGTTSTLQEQI

SEQ ID NO: 4440 - protein, 9 aa, HIV-1
IAGTTSTLQ

SEQ ID NO: 4441 - protein, 15 aa, HIV-1
GSEELRSLYNTVATL

SEQ ID NO: 4442 - protein, 9 aa, HIV-1
LRSLYNTVA

SEQ ID NO: 4443 - protein, 15 aa, HIV-1
GTTSTLQEQIGWMTN

SEQ ID NO: 4444 - protein, 9 aa, HIV-1
LQEQIGWMT

SEQ ID NO: 4445 - protein, 15 aa, HIV-1
GWMTNNPPIPVGEIY

SEQ ID NO: 4446 - protein, 9 aa, HIV-1
MTNNPPIPV

SEQ ID NO: 4447 - protein, 15 aa, HIV-1
HKARVLAEAMSQVTN

SEQ ID NO: 4448 - protein, 9 aa, HIV-1
LAEAMSQVT

SEQ ID NO: 4449 - protein, 15 aa, HIV-1
HPVHAGPIAPGQMRE

SEQ ID NO: 4450 - protein, 9 aa, HIV-1
VHAGPIAPG

SEQ ID NO: 4451 - protein, 15 aa, HIV-1
IAGTTSTLQEQIGWM

SEQ ID NO: 4452 - protein, 9 aa, HIV-1
IAGTTSTLQ

SEQ ID NO: 4453 - protein, 15 aa, HIV-1
IDKELYPLTSLRSLF

SEQ ID NO: 4454 - protein, 9 aa, HIV-1
LYPLTSLRS

SEQ ID NO: 4455 - protein, 15 aa, HIV-1
IGWMTNNPPIPVGEI

SEQ ID NO: 4456 - protein, 9 aa, HIV-1
IGWMTNNPP

SEQ ID NO: 4457 - protein, 15 aa, HIV-1
IGWMTNNPPIPVGEI

SEQ ID NO: 4458 - protein, 9 aa, HIV-1
MTNNPPIPV

SEQ ID NO: 4459 - protein, 15 aa, HIV-1
IGWMTNNPPIPVGEI

SEQ ID NO: 4460 - protein, 9 aa, HIV-1
WMTNNPPIP

SEQ ID NO: 4461 - protein, 15 aa, HIV-1
IILGLNKIVRMYSPT

SEQ ID NO: 4462 - protein, 9 aa, HIV-1
ILGLNKIVR

SEQ ID NO: 4463 - protein, 15 aa, HIV-1
IILGLNKIVRMYSPT

SEQ ID NO: 4464 - protein, 9 aa, HIV-1
LGLNKIVRM

SEQ ID NO: 4465 - protein, 15 aa, HIV-1
IILGLNKIVRMYSPT

SEQ ID NO: 4466 - protein, 9 aa, HIV-1
LNKIVRMYS

SEQ ID NO: 4467 - protein, 15 aa, HIV-1
ILGLNKIVRMYSPTS

SEQ ID NO: 4468 - protein, 9 aa, HIV-1
ILGLNKIVR

SEQ ID NO: 4469 - protein, 15 aa, HIV-1
ILGLNKIVRMYSPTS

SEQ ID NO: 4470 - protein, 9 aa, HIV-1
LGLNKIVRM

SEQ ID NO: 4471 - protein, 15 aa, HIV-1
ILGLNKIVRMYSPTS

SEQ ID NO: 4472 - protein, 9 aa, HIV-1
LNKIVRMYS

SEQ ID NO: 4473 - protein, 15 aa, HIV-1
ILGQLQPSLQTGSEE

SEQ ID NO: 4474 - protein, 9 aa, HIV-1
GQLQPSLQT

SEQ ID NO: 4475 - protein, 15 aa, HIV-1
ILGQLQPSLQTGSEE

SEQ ID NO: 4476 - protein, 9 aa, HIV-1
LGQLQPSLQ

SEQ ID NO: 4477 - protein, 15 aa, HIV-1
ILKALGPAATLEEMM

SEQ ID NO: 4478 - protein, 9 aa, HIV-1
LKALGPAAT

SEQ ID NO: 4479 - protein, 15 aa, HIV-1
IMMQRGNFRNQRKIV

SEQ ID NO: 4480 - protein, 9 aa, HIV-1
IMMQRGNFR

SEQ ID NO: 4481 - protein, 15 aa, HIV-1
IPMFSALSEGATPQD

SEQ ID NO: 4482 - protein, 9 aa, HIV-1
MFSALSEGA

SEQ ID NO: 4483 - protein, 15 aa, HIV-1
IPVGEIYKRWIILGL

SEQ ID NO: 4484 - protein, 9 aa, HIV-1
IYKRWIILG

SEQ ID NO: 4485 - protein, 15 aa, HIV-1
IQGQMVHQAISPRTL

SEQ ID NO: 4486 - protein, 9 aa, HIV-1
MVHQAISPR

SEQ ID NO: 4487 - protein, 15 aa, HIV-1
IQGQMVHQAISPRTL

SEQ ID NO: 4488 - protein, 9 aa, HIV-1
VHQAISPRT

SEQ ID NO: 4489 - protein, 15 aa, HIV-1
ISPRTLNAWVKVVEE

SEQ ID NO: 4490 - protein, 9 aa, HIV-1
LNAWVKVVE

SEQ ID NO: 4491 - protein, 15 aa, HIV-1
ISPRTLNAWVKVVEE

SEQ ID NO: 4492 - protein, 9 aa, HIV-1
TLNAWVKVV

SEQ ID NO: 4493 - protein, 15 aa, HIV-1
IVQNIQGQMVHQAIS

SEQ ID NO: 4494 - protein, 9 aa, HIV-1
IQGQMVHQA

SEQ ID NO: 4495 - protein, 15 aa, HIV-1
IVRMYSPTSILDIRQ

SEQ ID NO: 4496 - protein, 9 aa, HIV-1
IVRMYSPTS

SEQ ID NO: 4497 - protein, 15 aa, HIV-1
IVRMYSPTSILDIRQ

SEQ ID NO: 4498 - protein, 9 aa, HIV-1
VRMYSPTSI

SEQ ID NO: 4499 - protein, 15 aa, HIV-1
IVRMYSPTSILDIRQ

SEQ ID NO: 4500 - protein, 9 aa, HIV-1
YSPTSILDI

SEQ ID NO: 4501 - protein, 15 aa, HIV-1
IWPSYKGRPGNFLQS

SEQ ID NO: 4502 - protein, 9 aa, HIV-1
YKGRPGNFL

SEQ ID NO: 4503 - protein, 15 aa, HIV-1
IYKRWIILGLNKIVR

SEQ ID NO: 4504 - protein, 9 aa, HIV-1
WIILGLNKI

SEQ ID NO: 4505 - protein, 15 aa, HIV-1
IYKRWIILGLNKIVR

SEQ ID NO: 4506 - protein, 9 aa, HIV-1
YKRWIILGL

SEQ ID NO: 4507 - protein, 15 aa, HIV-1
KAFSPEVIPMFSALS

SEQ ID NO: 4508 - protein, 9 aa, HIV-1
EVIPMFSAL

SEQ ID NO: 4509 - protein, 15 aa, HIV-1
KAFSPEVIPMFSALS

SEQ ID NO: 4510 - protein, 9 aa, HIV-1
FSPEVIPMF

SEQ ID NO: 4511 - protein, 15 aa, HIV-1
KAFSPEVIPMFSALS

SEQ ID NO: 4512 - protein, 9 aa, HIV-1
KAFSPEVIP

SEQ ID NO: 4513 - protein, 15 aa, HIV-1
KALGPAATLEEMMTA

SEQ ID NO: 4514 - protein, 9 aa, HIV-1
LGPAATLEE

SEQ ID NO: 4515 - protein, 15 aa, HIV-1
KARVLAEAMSQVTNS

SEQ ID NO: 4516 - protein, 9 aa, HIV-1
LAEAMSQVT

SEQ ID NO: 4517 - protein, 15 aa, HIV-1
KELYPLTSLRSLFGN

SEQ ID NO: 4518 - protein, 9 aa, HIV-1
ELYPLTSLR

SEQ ID NO: 4519 - protein, 15 aa, HIV-1
KELYPLTSLRSLFGN

SEQ ID NO: 4520 - protein, 9 aa, HIV-1
LYPLTSLRS

SEQ ID NO: 4521 - protein, 15 aa, HIV-1
KGRPGNFLQSRPEPT

SEQ ID NO: 4522 - protein, 9 aa, HIV-1
GRPGNFLQS

SEQ ID NO: 4523 - protein, 15 aa, HIV-1
KGRPGNFLQSRPEPT

SEQ ID NO: 4524 - protein, 9 aa, HIV-1
NFLQSRPEP

SEQ ID NO: 4525 - protein, 15 aa, HIV-1
KIVRMYSPTSILDIR

SEQ ID NO: 4526 - protein, 9 aa, HIV-1
IVRMYSPTS

SEQ ID NO: 4527 - protein, 15 aa, HIV-1
KIVRMYSPTSILDIR

SEQ ID NO: 4528 - protein, 9 aa, HIV-1
VRMYSPTSI

SEQ ID NO: 4529 - protein, 15 aa, HIV-1
KIVRMYSPTSILDIR

SEQ ID NO: 4530 - protein, 9 aa, HIV-1
YSPTSILDI

SEQ ID NO: 4531 - protein, 15 aa, HIV-1
KIWPSYKGRPGNFLQ

SEQ ID NO: 4532 - protein, 9 aa, HIV-1
YKGRPGNFL

SEQ ID NO: 4533 - protein, 15 aa, HIV-1
KKKYKLKHIVWASRE

SEQ ID NO: 4534 - protein, 9 aa, HIV-1
LKHIVWASR

SEQ ID NO: 4535 - protein, 15 aa, HIV-1
KKKYKLKHIVWASRE

SEQ ID NO: 4536 - protein, 9 aa, HIV-1
YKLKHIVWA

SEQ ID NO: 4537 - protein, 15 aa, HIV-1
KKYKLKHIVWASREL

SEQ ID NO: 4538 - protein, 9 aa, HIV-1
LKHIVWASR

SEQ ID NO: 4539 - protein, 15 aa, HIV-1
KKYKLKHIVWASREL

SEQ ID NO: 4540 - protein, 9 aa, HIV-1
YKLKHIVWA

SEQ ID NO: 4541 - protein, 15 aa, HIV-1
KLKHIVWASRELERF

SEQ ID NO: 4542 - protein, 9 aa, HIV-1
LKHIVWASR

SEQ ID NO: 4543 - protein, 15 aa, HIV-1
KNWMTETLLVQNANP

SEQ ID NO: 4544 - protein, 9 aa, HIV-1
WMTETLLVQ

SEQ ID NO: 4545 - protein, 15 aa, HIV-1
KRWIILGLNKIVRMY

SEQ ID NO: 4546 - protein, 9 aa, HIV-1
ILGLNKIVR

SEQ ID NO: 4547 - protein, 15 aa, HIV-1
KRWIILGLNKIVRMY

SEQ ID NO: 4548 - protein, 9 aa, HIV-1
LGLNKIVRM

SEQ ID NO: 4549 - protein, 15 aa, HIV-1
KRWIILGLNKIVRMY

SEQ ID NO: 4550 - protein, 9 aa, HIV-1
WIILGLNKI

SEQ ID NO: 4551 - protein, 15 aa, HIV-1
KTILKALGPAATLEE

SEQ ID NO: 4552 - protein, 9 aa, HIV-1
ILKALGPAA

SEQ ID NO: 4553 - protein, 15 aa, HIV-1
KTILKALGPAATLEE

SEQ ID NO: 4554 - protein, 9 aa, HIV-1
LKALGPAAT

SEQ ID NO: 4555 - protein, 15 aa, HIV-1
KYKLKHIVWASRELE

SEQ ID NO: 4556 - protein, 9 aa, HIV-1
LKHIVWASR

SEQ ID NO: 4557 - protein, 15 aa, HIV-1
LAEAMSQVTNSATIM

SEQ ID NO: 4558 - protein, 9 aa, HIV-1
AMSQVTNSA

SEQ ID NO: 4559 - protein, 15 aa, HIV-1
LAEAMSQVTNSATIM

SEQ ID NO: 4560 - protein, 9 aa, HIV-1
LAEAMSQVT

SEQ ID NO: 4561 - protein, 15 aa, HIV-1
LEEMMTACQGVGGPG

SEQ ID NO: 4562 - protein, 9 aa, HIV-1
MTACQGVGG

SEQ ID NO: 4563 - protein, 15 aa, HIV-1
LERFAVNPGLLETSE

SEQ ID NO: 4564 - protein, 9 aa, HIV-1
FAVNPGLLE

SEQ ID NO: 4565 - protein, 15 aa, HIV-1
LERFAVNPGLLETSE

SEQ ID NO: 4566 - protein, 9 aa, HIV-1
VNPGLLETS

SEQ ID NO: 4567 - protein, 15 aa, HIV-1
LGKIWPSYKGRPGNF

SEQ ID NO: 4568 - protein, 9 aa, HIV-1
LGKIWPSYK

SEQ ID NO: 4569 - protein, 15 aa, HIV-1
LGLNKIVRMYSPTSI

SEQ ID NO: 4570 - protein, 9 aa, HIV-1
IVRMYSPTS

SEQ ID NO: 4571 - protein, 15 aa, HIV-1
LGLNKIVRMYSPTSI

SEQ ID NO: 4572 - protein, 9 aa, HIV-1
LGLNKIVRM

SEQ ID NO: 4573 - protein, 15 aa, HIV-1
LGLNKIVRMYSPTSI

SEQ ID NO: 4574 - protein, 9 aa, HIV-1
LNKIVRMYS

SEQ ID NO: 4575 - protein, 15 aa, HIV-1
LGPAATLEEMMTACQ

SEQ ID NO: 4576 - protein, 9 aa, HIV-1
AATLEEMMT

SEQ ID NO: 4577 - protein, 15 aa, HIV-1
LGQLQPSLQTGSEEL

SEQ ID NO: 4578 - protein, 9 aa, HIV-1
LGQLQPSLQ

SEQ ID NO: 4579 - protein, 15 aa, HIV-1
LKALGPAATLEEMMT

SEQ ID NO: 4580 - protein, 9 aa, HIV-1
LKALGPAAT

SEQ ID NO: 4581 - protein, 15 aa, HIV-1
LKHIVWASRELERFA

SEQ ID NO: 4582 - protein, 9 aa, HIV-1
LKHIVWASR

SEQ ID NO: 4583 - protein, 15 aa, HIV-1
LLVQNANPDCKTILK

SEQ ID NO: 4584 - protein, 9 aa, HIV-1
VQNANPDCK

SEQ ID NO: 4585 - protein, 15 aa, HIV-1
LNKIVRMYSPTSILD

SEQ ID NO: 4586 - protein, 9 aa, HIV-1
IVRMYSPTS

SEQ ID NO: 4587 - protein, 15 aa, HIV-1
LNKIVRMYSPTSILD

SEQ ID NO: 4588 - protein, 9 aa, HIV-1
LNKIVRMYS

SEQ ID NO: 4589 - protein, 15 aa, HIV-1
LNKIVRMYSPTSILD

SEQ ID NO: 4590 - protein, 9 aa, HIV-1
VRMYSPTSI

SEQ ID NO: 4591 - protein, 15 aa, HIV-1
LNTMLNTVGGHQAAM

SEQ ID NO: 4592 - protein, 9 aa, HIV-1
LNTMLNTVG

SEQ ID NO: 4593 - protein, 15 aa, HIV-1
LNTMLNTVGGHQAAM

SEQ ID NO: 4594 - protein, 9 aa, HIV-1
MLNTVGGHQ

SEQ ID NO: 4595 - protein, 15 aa, HIV-1
LNTVGGHQAAMQMLK

SEQ ID NO: 4596 - protein, 9 aa, HIV-1
VGGHQAAMQ

SEQ ID NO: 4597 - protein, 15 aa, HIV-1
LQEQIGWMTNNPPIP

SEQ ID NO: 4598 - protein, 9 aa, HIV-1
IGWMTNNPP

SEQ ID NO: 4599 - protein, 15 aa, HIV-1
LRSLYNTVATLYCVH

SEQ ID NO: 4600 - protein, 9 aa, HIV-1
LYNTVATLY

SEQ ID NO: 4601 - protein, 15 aa, HIV-1
LRSLYNTVATLYCVH

SEQ ID NO: 4602 - protein, 9 aa, HIV-1
YNTVATLYC

SEQ ID NO: 4603 - protein, 15 aa, HIV-1
LTSLRSLFGNDPSSQ

SEQ ID NO: 4604 - protein, 9 aa, HIV-1
LTSLRSLFG

SEQ ID NO: 4605 - protein, 15 aa, HIV-1
LYNTVATLYCVHQRI

SEQ ID NO: 4606 - protein, 9 aa, HIV-1
LYNTVATLY

SEQ ID NO: 4607 - protein, 15 aa, HIV-1
LYNTVATLYCVHQRI

SEQ ID NO: 4608 - protein, 9 aa, HIV-1
YNTVATLYC

SEQ ID NO: 4609 - protein, 15 aa, HIV-1
LYPLTSLRSLFGNDP

SEQ ID NO: 4610 - protein, 9 aa, HIV-1
LTSLRSLFG

SEQ ID NO: 4611 - protein, 15 aa, HIV-1
LYPLTSLRSLFGNDP

SEQ ID NO: 4612 - protein, 9 aa, HIV-1
LYPLTSLRS

SEQ ID NO: 4613 - protein, 15 aa, HIV-1
MFSALSEGATPQDLN

SEQ ID NO: 4614 - protein, 9 aa, HIV-1
MFSALSEGA

SEQ ID NO: 4615 - protein, 15 aa, HIV-1
MGARASVLSGGELDR

SEQ ID NO: 4616 - protein, 9 aa, HIV-1
MGARASVLS

SEQ ID NO: 4617 - protein, 15 aa, HIV-1
MLNTVGGHQAAMQML

SEQ ID NO: 4618 - protein, 9 aa, HIV-1
MLNTVGGHQ

SEQ ID NO: 4619 - protein, 15 aa, HIV-1
MLNTVGGHQAAMQML

SEQ ID NO: 4620 - protein, 9 aa, HIV-1
VGGHQAAMQ

SEQ ID NO: 4621 - protein, 15 aa, HIV-1
MMQRGNFRNQRKIVK

SEQ ID NO: 4622 - protein, 9 aa, HIV-1
NFRNQRKIV

SEQ ID NO: 4623 - protein, 15 aa, HIV-1
MMQRGNFRNQRKIVK

SEQ ID NO: 4624 - protein, 9 aa, HIV-1
QRGNFRNQR

SEQ ID NO: 4625 - protein, 15 aa, HIV-1
MMQRGNFRNQRKIVK

SEQ ID NO: 4626 - protein, 9 aa, HIV-1
RGNFRNQRK

SEQ ID NO: 4627 - protein, 15 aa, HIV-1
MQRGNFRNQRKIVKC

SEQ ID NO: 4628 - protein, 9 aa, HIV-1
FRNQRKIVK

SEQ ID NO: 4629 - protein, 15 aa, HIV-1
MSQVTNSATIMMQRG

SEQ ID NO: 4630 - protein, 9 aa, HIV-1
VTNSATIMM

SEQ ID NO: 4631 - protein, 15 aa, HIV-1
MTETLLVQNANPDCK

SEQ ID NO: 4632 - protein, 9 aa, HIV-1
LLVQNANPD

SEQ ID NO: 4633 - protein, 15 aa, HIV-1
MTETLLVQNANPDCK

SEQ ID NO: 4634 - protein, 9 aa, HIV-1
MTETLLVQN

SEQ ID NO: 4635 - protein, 15 aa, HIV-1
MTNNPPIPVGEIYKR

SEQ ID NO: 4636 - protein, 9 aa, HIV-1
MTNNPPIPV

SEQ ID NO: 4637 - protein, 15 aa, HIV-1
MVHQAISPRTLNAWV

SEQ ID NO: 4638 - protein, 9 aa, HIV-1
MVHQAISPR

SEQ ID NO: 4639 - protein, 15 aa, HIV-1
MVHQAISPRTLNAWV

SEQ ID NO: 4640 - protein, 9 aa, HIV-1
VHQAISPRT

SEQ ID NO: 4641 - protein, 15 aa, HIV-1
NFLGKIWPSYKGRPG

SEQ ID NO: 4642 - protein, 9 aa, HIV-1
FLGKIWPSY

SEQ ID NO: 4643 - protein, 15 aa, HIV-1
NFLGKIWPSYKGRPG

SEQ ID NO: 4644 - protein, 9 aa, HIV-1
GKIWPSYKG

SEQ ID NO: 4645 - protein, 15 aa, HIV-1
NFLGKIWPSYKGRPG

SEQ ID NO: 4646 - protein, 9 aa, HIV-1
LGKIWPSYK

SEQ ID NO: 4647 - protein, 15 aa, HIV-1
NFLQSRPEPTAPPEE

SEQ ID NO: 4648 - protein, 9 aa, HIV-1
FLQSRPEPT

SEQ ID NO: 4649 - protein, 15 aa, HIV-1
NFRNQRKIVKCFNCG

SEQ ID NO: 4650 - protein, 9 aa, HIV-1
FRNQRKIVK

SEQ ID NO: 4651 - protein, 15 aa, HIV-1
NIQGQMVHQAISPRT

SEQ ID NO: 4652 - protein, 9 aa, HIV-1
IQGQMVHQA

SEQ ID NO: 4653 - protein, 15 aa, HIV-1
NIQGQMVHQAISPRT

SEQ ID NO: 4654 - protein, 9 aa, HIV-1
MVHQAISPR

SEQ ID NO: 4655 - protein, 15 aa, HIV-1
NKIVRMYSPTSILDI

SEQ ID NO: 4656 - protein, 9 aa, HIV-1
IVRMYSPTS

SEQ ID NO: 4657 - protein, 15 aa, HIV-1
NKIVRMYSPTSILDI

SEQ ID NO: 4658 - protein, 9 aa, HIV-1
VRMYSPTSI

SEQ ID NO: 4659 - protein, 15 aa, HIV-1
NPDCKTILKALGPAA

SEQ ID NO: 4660 - protein, 9 aa, HIV-1
CKTILKALG

SEQ ID NO: 4661 - protein, 15 aa, HIV-1
NPDCKTILKALGPAA

SEQ ID NO: 4662 - protein, 9 aa, HIV-1
KTILKALGP

SEQ ID NO: 4663 - protein, 15 aa, HIV-1
NSATIMMQRGNFRNQ

SEQ ID NO: 4664 - protein, 9 aa, HIV-1
IMMQRGNFR

SEQ ID NO: 4665 - protein, 15 aa, HIV-1
NTMLNTVGGHQAAMQ

SEQ ID NO: 4666 - protein, 9 aa, HIV-1
LNTVGGHQA

SEQ ID NO: 4667 - protein, 15 aa, HIV-1
NTMLNTVGGHQAAMQ

SEQ ID NO: 4668 - protein, 9 aa, HIV-1
MLNTVGGHQ

SEQ ID NO: 4669 - protein, 15 aa, HIV-1
NTVGGHQAAMQMLKE

SEQ ID NO: 4670 - protein, 9 aa, HIV-1
VGGHQAAMQ

SEQ ID NO: 4671 - protein, 15 aa, HIV-1
NYPIVQNIQGQMVHQ

SEQ ID NO: 4672 - protein, 9 aa, HIV-1
VQNIQGQMV

SEQ ID NO: 4673 - protein, 15 aa, HIV-1
PDCKTILKALGPAAT

SEQ ID NO: 4674 - protein, 9 aa, HIV-1
CKTILKALG

SEQ ID NO: 4675 - protein, 15 aa, HIV-1
PDCKTILKALGPAAT

SEQ ID NO: 4676 - protein, 9 aa, HIV-1
ILKALGPAA

SEQ ID NO: 4677 - protein, 15 aa, HIV-1
PEESFRSGVETTTPP

SEQ ID NO: 4678 - protein, 9 aa, HIV-1
FRSGVETTT

SEQ ID NO: 4679 - protein, 15 aa, HIV-1
PEVIPMFSALSEGAT

SEQ ID NO: 4680 - protein, 9 aa, HIV-1
VIPMFSALS

SEQ ID NO: 4681 - protein, 15 aa, HIV-1
PGHKARVLAEAMSQV

SEQ ID NO: 4682 - protein, 9 aa, HIV-1
ARVLAEAMS

SEQ ID NO: 4683 - protein, 15 aa, HIV-1
PGNFLQSRPEPTAPP

SEQ ID NO: 4684 - protein, 9 aa, HIV-1
FLQSRPEPT

SEQ ID NO: 4685 - protein, 15 aa, HIV-1
PIDKELYPLTSLRSL

SEQ ID NO: 4686 - protein, 9 aa, HIV-1
LYPLTSLRS

SEQ ID NO: 4687 - protein, 15 aa, HIV-1
PIVQNIQGQMVHQAI

SEQ ID NO: 4688 - protein, 9 aa, HIV-1
VQNIQGQMV

SEQ ID NO: 4689 - protein, 15 aa, HIV-1
PLTSLRSLFGNDPSS

SEQ ID NO: 4690 - protein, 9 aa, HIV-1
LTSLRSLFG

SEQ ID NO: 4691 - protein, 15 aa, HIV-1
PMFSALSEGATPQDL

SEQ ID NO: 4692 - protein, 9 aa, HIV-1
MFSALSEGA

SEQ ID NO: 4693 - protein, 15 aa, HIV-1
PPEESFRSGVETTTP

SEQ ID NO: 4694 - protein, 9 aa, HIV-1
FRSGVETTT

SEQ ID NO: 4695 - protein, 15 aa, HIV-1
PQDLNTMLNTVGGHQ

SEQ ID NO: 4696 - protein, 9 aa, HIV-1
DLNTMLNTV

SEQ ID NO: 4697 - protein, 15 aa, HIV-1
PQDLNTMLNTVGGHQ

SEQ ID NO: 4698 - protein, 9 aa, HIV-1
LNTMLNTVG

SEQ ID NO: 4699 - protein, 15 aa, HIV-1
PRGSDIAGTTSTLQE

SEQ ID NO: 4700 - protein, 9 aa, HIV-1
IAGTTSTLQ

SEQ ID NO: 4701 - protein, 15 aa, HIV-1
PRTLNAWVKVVEEKA

SEQ ID NO: 4702 - protein, 9 aa, HIV-1
LNAWVKVVE

SEQ ID NO: 4703 - protein, 15 aa, HIV-1
PRTLNAWVKVVEEKA

SEQ ID NO: 4704 - protein, 9 aa, HIV-1
TLNAWVKVV

SEQ ID NO: 4705 - protein, 15 aa, HIV-1
PSYKGRPGNFLQSRP

SEQ ID NO: 4706 - protein, 9 aa, HIV-1
YKGRPGNFL

SEQ ID NO: 4707 - protein, 15 aa, HIV-1
PVGEIYKRWIILGLN

SEQ ID NO: 4708 - protein, 9 aa, HIV-1
YKRWIILGL

SEQ ID NO: 4709 - protein, 15 aa, HIV-1
PVHAGPIAPGQMREP

SEQ ID NO: 4710 - protein, 9 aa, HIV-1
VHAGPIAPG

SEQ ID NO: 4711 - protein, 15 aa, HIV-1
PAATLEEMMTACQGV

SEQ ID NO: 4712 - protein, 9 aa, HIV-1
LEEMMTACQ

SEQ ID NO: 4713 - protein, 15 aa, HIV-1
QAISPRTLNAWVKVV

SEQ ID NO: 4714 - protein, 9 aa, HIV-1
ISPRTLNAW

SEQ ID NO: 4715 - protein, 15 aa, HIV-1
QANFLGKIWPSYKGR

SEQ ID NO: 4716 - protein, 9 aa, HIV-1
FLGKIWPSY

SEQ ID NO: 4717 - protein, 15 aa, HIV-1
QANFLGKIWPSYKGR

SEQ ID NO: 4718 - protein, 9 aa, HIV-1
GKIWPSYKG

SEQ ID NO: 4719 - protein, 15 aa, HIV-1
QANFLGKIWPSYKGR

SEQ ID NO: 4720 - protein, 9 aa, HIV-1
LGKIWPSYK

SEQ ID NO: 4721 - protein, 15 aa, HIV-1
QASQEVKNWMTETLL

SEQ ID NO: 4722 - protein, 9 aa, HIV-1
VKNWMTETL

SEQ ID NO: 4723 - protein, 15 aa, HIV-1
QDLNTMLNTVGGHQA

SEQ ID NO: 4724 - protein, 9 aa, HIV-1
LNTMLNTVG

SEQ ID NO: 4725 - protein, 15 aa, HIV-1
QDLNTMLNTVGGHQA

SEQ ID NO: 4726 - protein, 9 aa, HIV-1
MLNTVGGHQ

SEQ ID NO: 4727 - protein, 15 aa, HIV-1
QEQIGWMTNNPPIPV

SEQ ID NO: 4728 - protein, 9 aa, HIV-1
IGWMTNNPP

SEQ ID NO: 4729 - protein, 15 aa, HIV-1
QEVKNWMTETLLVQN

SEQ ID NO: 4730 - protein, 9 aa, HIV-1
VKNWMTETL

SEQ ID NO: 4731 - protein, 15 aa, HIV-1
QGQMVHQAISPRTLN

SEQ ID NO: 4732 - protein, 9 aa, HIV-1
MVHQAISPR

SEQ ID NO: 4733 - protein, 15 aa, HIV-1
QGQMVHQAISPRTLN

SEQ ID NO: 4734 - protein, 9 aa, HIV-1
VHQAISPRT

SEQ ID NO: 4735 - protein, 15 aa, HIV-1
QIGWMTNNPPIPVGE

SEQ ID NO: 4736 - protein, 9 aa, HIV-1
IGWMTNNPP

SEQ ID NO: 4737 - protein, 15 aa, HIV-1
QIGWMTNNPPIPVGE

SEQ ID NO: 4738 - protein, 9 aa, HIV-1
MTNNPPIPV

SEQ ID NO: 4739 - protein, 15 aa, HIV-1
QIGWMTNNPPIPVGE

SEQ ID NO: 4740 - protein, 9 aa, HIV-1
WMTNNPPIP

SEQ ID NO: 4741 - protein, 15 aa, HIV-1
QILGQLQPSLQTGSE

SEQ ID NO: 4742 - protein, 9 aa, HIV-1
GQLQPSLQT

SEQ ID NO: 4743 - protein, 15 aa, HIV-1
QILGQLQPSLQTGSE

SEQ ID NO: 4744 - protein, 9 aa, HIV-1
LGQLQPSLQ

SEQ ID NO: 4745 - protein, 15 aa, HIV-1
QMVHQAISPRTLNAW

SEQ ID NO: 4746 - protein, 9 aa, HIV-1
MVHQAISPR

SEQ ID NO: 4747 - protein, 15 aa, HIV-1
QMVHQAISPRTLNAW

SEQ ID NO: 4748 - protein, 9 aa, HIV-1
VHQAISPRT

SEQ ID NO: 4749 - protein, 15 aa, HIV-1
QNIQGQMVHQAISPR

SEQ ID NO: 4750 - protein, 9 aa, HIV-1
IQGQMVHQA

SEQ ID NO: 4751 - protein, 15 aa, HIV-1
QNYPIVQNIQGQMVH

SEQ ID NO: 4752 - protein, 9 aa, HIV-1
VQNIQGQMV

SEQ ID NO: 4753 - protein, 15 aa, HIV-1
QRGNFRNQRKIVKCF

SEQ ID NO: 4754 - protein, 9 aa, HIV-1
FRNQRKIVK

SEQ ID NO: 4755 - protein, 15 aa, HIV-1
QTGSEELRSLYNTVA

SEQ ID NO: 4756 - protein, 9 aa, HIV-1
SEELRSLYN

SEQ ID NO: 4757 - protein, 15 aa, HIV-1
QVTNSATIMMQRGNF

SEQ ID NO: 4758 - protein, 9 aa, HIV-1
VTNSATIMM

SEQ ID NO: 4759 - protein, 15 aa, HIV-1
RDYVDRFYKTLRAEQ

SEQ ID NO: 4760 - protein, 9 aa, HIV-1
DRFYKTLRA

SEQ ID NO: 4761 - protein, 15 aa, HIV-1
RDYVDRFYKTLRAEQ

SEQ ID NO: 4762 - protein, 9 aa, HIV-1
DYVDRFYKT

SEQ ID NO: 4763 - protein, 15 aa, HIV-1
RDYVDRFYKTLRAEQ

SEQ ID NO: 4764 - protein, 9 aa, HIV-1
VDRFYKTLR

SEQ ID NO: 4765 - protein, 15 aa, HIV-1
RELERFAVNPGLLET

SEQ ID NO: 4766 - protein, 9 aa, HIV-1
FAVNPGLLE

SEQ ID NO: 4767 - protein, 15 aa, HIV-1
RELERFAVNPGLLET

SEQ ID NO: 4768 - protein, 9 aa, HIV-1
LERFAVNPG

SEQ ID NO: 4769 - protein, 15 aa, HIV-1
RFAVNPGLLETSEGC

SEQ ID NO: 4770 - protein, 9 aa, HIV-1
FAVNPGLLE

SEQ ID NO: 4771 - protein, 15 aa, HIV-1
RFAVNPGLLETSEGC

SEQ ID NO: 4772 - protein, 9 aa, HIV-1
VNPGLLETS

SEQ ID NO: 4773 - protein, 15 aa, HIV-1
RFYKTLRAEQASQEV

SEQ ID NO: 4774 - protein, 9 aa, HIV-1
FYKTLRAEQ

SEQ ID NO: 4775 - protein, 15 aa, HIV-1
RFYKTLRAEQASQEV

SEQ ID NO: 4776 - protein, 9 aa, HIV-1
YKTLRAEQA

SEQ ID NO: 4777 - protein, 15 aa, HIV-1
RGNFRNQRKIVKCFN

SEQ ID NO: 4778 - protein, 9 aa, HIV-1
FRNQRKIVK

SEQ ID NO: 4779 - protein, 15 aa, HIV-1
RGSDIAGTTSTLQEQ

SEQ ID NO: 4780 - protein, 9 aa, HIV-1
IAGTTSTLQ

SEQ ID NO: 4781 - protein, 15 aa, HIV-1
RMYSPTSILDIRQGP

SEQ ID NO: 4782 - protein, 9 aa, HIV-1
YSPTSILDI

SEQ ID NO: 4783 - protein, 15 aa, HIV-1
RPGNFLQSRPEPTAP

SEQ ID NO: 4784 - protein, 9 aa, HIV-1
FLQSRPEPT

SEQ ID NO: 4785 - protein, 15 aa, HIV-1
RQANFLGKIWPSYKG

SEQ ID NO: 4786 - protein, 9 aa, HIV-1
FLGKIWPSY

SEQ ID NO: 4787 - protein, 15 aa, HIV-1
RQANFLGKIWPSYKG

SEQ ID NO: 4788 - protein, 9 aa, HIV-1
LGKIWPSYK

SEQ ID NO: 4789 - protein, 15 aa, HIV-1
RQILGQLQPSLQTGS

SEQ ID NO: 4790 - protein, 9 aa, HIV-1
GQLQPSLQT

SEQ ID NO: 4791 - protein, 15 aa, HIV-1
RQILGQLQPSLQTGS

SEQ ID NO: 4792 - protein, 9 aa, HIV-1
LGQLQPSLQ

SEQ ID NO: 4793 - protein, 15 aa, HIV-1
RSGVETTTPPQKQEP

SEQ ID NO: 4794 - protein, 9 aa, HIV-1
VETTTPPQK

SEQ ID NO: 4795 - protein, 15 aa, HIV-1
RSLYNTVATLYCVHQ

SEQ ID NO: 4796 - protein, 9 aa, HIV-1
LYNTVATLY

SEQ ID NO: 4797 - protein, 15 aa, HIV-1
RSLYNTVATLYCVHQ

SEQ ID NO: 4798 - protein, 9 aa, HIV-1
YNTVATLYC

SEQ ID NO: 4799 - protein, 15 aa, HIV-1
RTLNAWVKVVEEKAF

SEQ ID NO: 4800 - protein, 9 aa, HIV-1
LNAWVKVVE

SEQ ID NO: 4801 - protein, 15 aa, HIV-1
RTLNAWVKVVEEKAF

SEQ ID NO: 4802 - protein, 9 aa, HIV-1
TLNAWVKVV

SEQ ID NO: 4803 - protein, 15 aa, HIV-1
RVHPVHAGPIAPGQM

SEQ ID NO: 4804 - protein, 9 aa, HIV-1
VHAGPIAPG

SEQ ID NO: 4805 - protein, 15 aa, HIV-1
RVLAEAMSQVTNSAT

SEQ ID NO: 4806 - protein, 9 aa, HIV-1
AMSQVTNSA

SEQ ID NO: 4807 - protein, 15 aa, HIV-1
RVLAEAMSQVTNSAT

SEQ ID NO: 4808 - protein, 9 aa, HIV-1
LAEAMSQVT

SEQ ID NO: 4809 - protein, 15 aa, HIV-1
RWIILGLNKIVRMYS

SEQ ID NO: 4810 - protein, 9 aa, HIV-1
ILGLNKIVR

SEQ ID NO: 4811 - protein, 15 aa, HIV-1
RWIILGLNKIVRMYS

SEQ ID NO: 4812 - protein, 9 aa, HIV-1
LGLNKIVRM

SEQ ID NO: 4813 - protein, 15 aa, HIV-1
RWIILGLNKIVRMYS

SEQ ID NO: 4814 - protein, 9 aa, HIV-1
WIILGLNKI

SEQ ID NO: 4815 - protein, 15 aa, HIV-1
SATIMMQRGNFRNQR

SEQ ID NO: 4816 - protein, 9 aa, HIV-1
IMMQRGNFR

SEQ ID NO: 4817 - protein, 15 aa, HIV-1
SDIAGTTSTLQEQIG

SEQ ID NO: 4818 - protein, 9 aa, HIV-1
IAGTTSTLQ

SEQ ID NO: 4819 - protein, 15 aa, HIV-1
SEELRSLYNTVATLY

SEQ ID NO: 4820 - protein, 9 aa, HIV-1
LRSLYNTVA

SEQ ID NO: 4821 - protein, 15 aa, HIV-1
SFRSGVETTTPPQKQ

SEQ ID NO: 4822 - protein, 9 aa, HIV-1
FRSGVETTT

SEQ ID NO: 4823 - protein, 15 aa, HIV-1
SFRSGVETTTPPQKQ

SEQ ID NO: 4824 - protein, 9 aa, HIV-1
VETTTPPQK

SEQ ID NO: 4825 - protein, 15 aa, HIV-1
SGVETTTPPQKQEPI

SEQ ID NO: 4826 - protein, 9 aa, HIV-1
VETTTPPQK

SEQ ID NO: 4827 - protein, 15 aa, HIV-1
SLYNTVATLYCVHQR

SEQ ID NO: 4828 - protein, 9 aa, HIV-1
LYNTVATLY

SEQ ID NO: 4829 - protein, 15 aa, HIV-1
SLYNTVATLYCVHQR

SEQ ID NO: 4830 - protein, 9 aa, HIV-1
YNTVATLYC

SEQ ID NO: 4831 - protein, 15 aa, HIV-1
SPEVIPMFSALSEGA

SEQ ID NO: 4832 - protein, 9 aa, HIV-1
VIPMFSALS

SEQ ID NO: 4833 - protein, 15 aa, HIV-1
SPRTLNAWVKVVEEK

SEQ ID NO: 4834 - protein, 9 aa, HIV-1
LNAWVKVVE

SEQ ID NO: 4835 - protein, 15 aa, HIV-1
SPRTLNAWVKVVEEK

SEQ ID NO: 4836 - protein, 9 aa, HIV-1
TLNAWVKVV

SEQ ID NO: 4837 - protein, 15 aa, HIV-1
SQEVKNWMTETLLVQ

SEQ ID NO: 4838 - protein, 9 aa, HIV-1
VKNWMTETL

SEQ ID NO: 4839 - protein, 15 aa, HIV-1
SQNYPIVQNIQGQMV

SEQ ID NO: 4840 - protein, 9 aa, HIV-1
IVQNIQGQM

SEQ ID NO: 4841 - protein, 15 aa, HIV-1
SQNYPIVQNIQGQMV

SEQ ID NO: 4842 - protein, 9 aa, HIV-1
SQNYPIVQN

SEQ ID NO: 4843 - protein, 15 aa, HIV-1
SQVTNSATIMMQRGN

SEQ ID NO: 4844 - protein, 9 aa, HIV-1
VTNSATIMM

SEQ ID NO: 4845 - protein, 15 aa, HIV-1
SRELERFAVNPGLLE

SEQ ID NO: 4846 - protein, 9 aa, HIV-1
LERFAVNPG

SEQ ID NO: 4847 - protein, 15 aa, HIV-1
STLQEQIGWMTNNPP

SEQ ID NO: 4848 - protein, 9 aa, HIV-1
LQEQIGWMT

SEQ ID NO: 4849 - protein, 15 aa, HIV-1
STLQEQIGWMTNNPP

SEQ ID NO: 4850 - protein, 9 aa, HIV-1
QIGWMTNNP

SEQ ID NO: 4851 - protein, 15 aa, HIV-1
SYKGRPGNFLQSRPE

SEQ ID NO: 4852 - protein, 9 aa, HIV-1
YKGRPGNFL

SEQ ID NO: 4853 - protein, 15 aa, HIV-1
TERQANFLGKIWPSY

SEQ ID NO: 4854 - protein, 9 aa, HIV-1
ANFLGKIWP

SEQ ID NO: 4855 - protein, 15 aa, HIV-1
TETLLVQNANPDCKT

SEQ ID NO: 4856 - protein, 9 aa, HIV-1
VQNANPDCK

SEQ ID NO: 4857 - protein, 15 aa, HIV-1
TGSEELRSLYNTVAT

SEQ ID NO: 4858 - protein, 9 aa, HIV-1
LRSLYNTVA

SEQ ID NO: 4859 - protein, 15 aa, HIV-1
TILKALGPAATLEEM

SEQ ID NO: 4860 - protein, 9 aa, HIV-1
LKALGPAAT

SEQ ID NO: 4861 - protein, 15 aa, HIV-1
TIMMQRGNFRNQRKI

SEQ ID NO: 4862 - protein, 9 aa, HIV-1
IMMQRGNFR

SEQ ID NO: 4863 - protein, 15 aa, HIV-1
TLEEMMTACQGVGGP

SEQ ID NO: 4864 - protein, 9 aa, HIV-1
MTACQGVGG

SEQ ID NO: 4865 - protein, 15 aa, HIV-1
TLLVQNANPDCKTIL

SEQ ID NO: 4866 - protein, 9 aa, HIV-1
VQNANPDCK

SEQ ID NO: 4867 - protein, 15 aa, HIV-1
TLNAWVKVVEEKAFS

SEQ ID NO: 4868 - protein, 9 aa, HIV-1
LNAWVKVVE

SEQ ID NO: 4869 - protein, 15 aa, HIV-1
TLQEQIGWMTNNPPI

SEQ ID NO: 4870 - protein, 9 aa, HIV-1
IGWMTNNPP

SEQ ID NO: 4871 - protein, 15 aa, HIV-1
TMLNTVGGHQAAMQM

SEQ ID NO: 4872 - protein, 9 aa, HIV-1
MLNTVGGHQ

SEQ ID NO: 4873 - protein, 15 aa, HIV-1
TMLNTVGGHQAAMQM

SEQ ID NO: 4874 - protein, 9 aa, HIV-1
VGGHQAAMQ

SEQ ID NO: 4875 - protein, 15 aa, HIV-1
TNSATIMMQRGNFRN

SEQ ID NO: 4876 - protein, 9 aa, HIV-1
IMMQRGNFR

SEQ ID NO: 4877 - protein, 15 aa, HIV-1
TPQDLNTMLNTVGGH

SEQ ID NO: 4878 - protein, 9 aa, HIV-1
LNTMLNTVG

SEQ ID NO: 4879 - protein, 15 aa, HIV-1
TSTLQEQIGWMTNNP

SEQ ID NO: 4880 - protein, 9 aa, HIV-1
LQEQIGWMT

SEQ ID NO: 4881 - protein, 15 aa, HIV-1
TTSTLQEQIGWMTNN

SEQ ID NO: 4882 - protein, 9 aa, HIV-1
LQEQIGWMT

SEQ ID NO: 4883 - protein, 15 aa, HIV-1
TVGGHQAAMQMLKET

SEQ ID NO: 4884 - protein, 9 aa, HIV-1
VGGHQAAMQ

SEQ ID NO: 4885 - protein, 15 aa, HIV-1
VDRFYKTLRAEQASQ

SEQ ID NO: 4886 - protein, 9 aa, HIV-1
DRFYKTLRA

SEQ ID NO: 4887 - protein, 15 aa, HIV-1
VDRFYKTLRAEQASQ

SEQ ID NO: 4888 - protein, 9 aa, HIV-1
FYKTLRAEQ

SEQ ID NO: 4889 - protein, 15 aa, HIV-1
VDRFYKTLRAEQASQ

SEQ ID NO: 4890 - protein, 9 aa, HIV-1
YKTLRAEQA

SEQ ID NO: 4891 - protein, 15 aa, HIV-1
VGEIYKRWIILGLNK

SEQ ID NO: 4892 - protein, 9 aa, HIV-1
YKRWIILGL

SEQ ID NO: 4893 - protein, 15 aa, HIV-1
VGGHQAAMQMLKETI

SEQ ID NO: 4894 - protein, 9 aa, HIV-1
VGGHQAAMQ

SEQ ID NO: 4895 - protein, 15 aa, HIV-1
VHAGPIAPGQMREPR

SEQ ID NO: 4896 - protein, 9 aa, HIV-1
VHAGPIAPG

SEQ ID NO: 4897 - protein, 15 aa, HIV-1
VHPVHAGPIAPGQMR

SEQ ID NO: 4898 - protein, 9 aa, HIV-1
VHAGPIAPG

SEQ ID NO: 4899 - protein, 15 aa, HIV-1
VHQAISPRTLNAWVK

SEQ ID NO: 4900 - protein, 9 aa, HIV-1
VHQAISPRT

SEQ ID NO: 4901 - protein, 15 aa, HIV-1
VIPMFSALSEGATPQ

SEQ ID NO: 4902 - protein, 9 aa, HIV-1
MFSALSEGA

SEQ ID NO: 4903 - protein, 15 aa, HIV-1
VIPMFSALSEGATPQ

SEQ ID NO: 4904 - protein, 9 aa, HIV-1
VIPMFSALS

SEQ ID NO: 4905 - protein, 15 aa, HIV-1
VKNWMTETLLVQNAN

SEQ ID NO: 4906 - protein, 9 aa, HIV-1
NWMTETLLV

SEQ ID NO: 4907 - protein, 15 aa, HIV-1
VKNWMTETLLVQNAN

SEQ ID NO: 4908 - protein, 9 aa, HIV-1
WMTETLLVQ

SEQ ID NO: 4909 - protein, 15 aa, HIV-1
VLAEAMSQVTNSATI

SEQ ID NO: 4910 - protein, 9 aa, HIV-1
AMSQVTNSA

SEQ ID NO: 4911 - protein, 15 aa, HIV-1
VLAEAMSQVTNSATI

SEQ ID NO: 4912 - protein, 9 aa, HIV-1
LAEAMSQVT

SEQ ID NO: 4913 - protein, 15 aa, HIV-1
VQNIQGQMVHQAISP

SEQ ID NO: 4914 - protein, 9 aa, HIV-1
IQGQMVHQA

SEQ ID NO: 4915 - protein, 15 aa, HIV-1
VRMYSPTSILDIRQG

SEQ ID NO: 4916 - protein, 9 aa, HIV-1
MYSPTSILD

SEQ ID NO: 4917 - protein, 15 aa, HIV-1
VRMYSPTSILDIRQG

SEQ ID NO: 4918 - protein, 9 aa, HIV-1
VRMYSPTSI

SEQ ID NO: 4919 - protein, 15 aa, HIV-1
VRMYSPTSILDIRQG

SEQ ID NO: 4920 - protein, 9 aa, HIV-1
YSPTSILDI

SEQ ID NO: 4921 - protein, 15 aa, HIV-1
VTNSATIMMQRGNFR

SEQ ID NO: 4922 - protein, 9 aa, HIV-1
SATIMMQRG

SEQ ID NO: 4923 - protein, 15 aa, HIV-1
VTNSATIMMQRGNFR

SEQ ID NO: 4924 - protein, 9 aa, HIV-1
VTNSATIMM

SEQ ID NO: 4925 - protein, 15 aa, HIV-1
WDRVHPVHAGPIAPG

SEQ ID NO: 4926 - protein, 9 aa, HIV-1
VHPVHAGPI

SEQ ID NO: 4927 - protein, 15 aa, HIV-1
WIILGLNKIVRMYSP

SEQ ID NO: 4928 - protein, 9 aa, HIV-1
ILGLNKIVR

SEQ ID NO: 4929 - protein, 15 aa, HIV-1
WIILGLNKIVRMYSP

SEQ ID NO: 4930 - protein, 9 aa, HIV-1
LGLNKIVRM

SEQ ID NO: 4931 - protein, 15 aa, HIV-1
WIILGLNKIVRMYSP

SEQ ID NO: 4932 - protein, 9 aa, HIV-1
LNKIVRMYS

SEQ ID NO: 4933 - protein, 15 aa, HIV-1
WIILGLNKIVRMYSP

SEQ ID NO: 4934 - protein, 9 aa, HIV-1
WIILGLNKI

SEQ ID NO: 4935 - protein, 15 aa, HIV-1
WMTNNPPIPVGEIYK

SEQ ID NO: 4936 - protein, 9 aa, HIV-1
MTNNPPIPV

SEQ ID NO: 4937 - protein, 15 aa, HIV-1
WPSYKGRPGNFLQSR

SEQ ID NO: 4938 - protein, 9 aa, HIV-1
YKGRPGNFL

SEQ ID NO: 4939 - protein, 15 aa, HIV-1
YKGRPGNFLQSRPEP

SEQ ID NO: 4940 - protein, 9 aa, HIV-1
YKGRPGNFL

SEQ ID NO: 4941 - protein, 15 aa, HIV-1
YKLKHIVWASRELER

SEQ ID NO: 4942 - protein, 9 aa, HIV-1
LKHIVWASR

SEQ ID NO: 4943 - protein, 15 aa, HIV-1
YKRWIILGLNKIVRM

SEQ ID NO: 4944 - protein, 9 aa, HIV-1
ILGLNKIVR

SEQ ID NO: 4945 - protein, 15 aa, HIV-1
YKRWIILGLNKIVRM

SEQ ID NO: 4946 - protein, 9 aa, HIV-1
WIILGLNKI

SEQ ID NO: 4947 - protein, 15 aa, HIV-1
YKTLRAEQASQEVKN

SEQ ID NO: 4948 - protein, 9 aa, HIV-1
YKTLRAEQA

SEQ ID NO: 4949 - protein, 15 aa, HIV-1
YNTVATLYCVHQRIE

SEQ ID NO: 4950 - protein, 9 aa, HIV-1
YNTVATLYC

SEQ ID NO: 4951 - protein, 15 aa, HIV-1
YPIVQNIQGQMVHQA

SEQ ID NO: 4952 - protein, 9 aa, HIV-1
VQNIQGQMV

SEQ ID NO: 4953 - protein, 15 aa, HIV-1
YPLTSLRSLFGNDPS

SEQ ID NO: 4954 - protein, 9 aa, HIV-1
LTSLRSLFG

SEQ ID NO: 4955 - protein, 15 aa, HIV-1
YVDRFYKTLRAEQAS

SEQ ID NO: 4956 - protein, 9 aa, HIV-1
DRFYKTLRA

SEQ ID NO: 4957 - protein, 15 aa, HIV-1
YVDRFYKTLRAEQAS

SEQ ID NO: 4958 - protein, 9 aa, HIV-1
FYKTLRAEQ

SEQ ID NO: 4959 - protein, 15 aa, HIV-1
YVDRFYKTLRAEQAS

SEQ ID NO: 4960 - protein, 9 aa, HIV-1
YKTLRAEQA

SEQ ID NO: 4961 - protein, 15 aa, HIV-1
AATLEEMMTACQGVG

SEQ ID NO: 4962 - protein, 9 aa, HIV-1
LEEMMTACQ

SEQ ID NO: 4963 - protein, 8 aa, HIV-1
MENRWQVM

SEQ ID NO: 4964 - protein, 8 aa, HIV-1
RWQVMIVW

SEQ ID NO: 4965 - protein, 8 aa, HIV-1
WQVMIVWQ

SEQ ID NO: 4966 - protein, 8 aa, HIV-1
QVMIVWQV

SEQ ID NO: 4967 - protein, 8 aa, HIV-1
MIVWQVDR

SEQ ID NO: 4968 - protein, 8 aa, HIV-1
IVWQVDRM

SEQ ID NO: 4969 - protein, 8 aa, HIV-1
WQVDRMRI

SEQ ID NO: 4970 - protein, 8 aa, HIV-1
RMRIRTWK

SEQ ID NO: 4971 - protein, 8 aa, HIV-1
RIRTWKSL

SEQ ID NO: 4972 - protein, 8 aa, HIV-1
RTWKSLVK

SEQ ID NO: 4973 - protein, 8 aa, HIV-1
KSLVKHHM

SEQ ID NO: 4974 - protein, 8 aa, HIV-1
SLVKHHMY

SEQ ID NO: 4975 - protein, 8 aa, HIV-1
LVKHHMYV

SEQ ID NO: 4976 - protein, 8 aa, HIV-1
HMYVSGKA

SEQ ID NO: 4977 - protein, 8 aa, HIV-1
MYVSGKAR

SEQ ID NO: 4978 - protein, 8 aa, HIV-1
VSGKARGW

SEQ ID NO: 4979 - protein, 8 aa, HIV-1
KARGWFYR

SEQ ID NO: 4980 - protein, 8 aa, HIV-1
GWFYRHHY

SEQ ID NO: 4981 - protein, 8 aa, HIV-1
HYESPHPR

SEQ ID NO: 4982 - protein, 8 aa, HIV-1
YESPHPRI

SEQ ID NO: 4983 - protein, 8 aa, HIV-1
SPHPRISS

SEQ ID NO: 4984 - protein, 8 aa, HIV-1
HPRISSEV

SEQ ID NO: 4985 - protein, 8 aa, HIV-1
RISSEVHI

SEQ ID NO: 4986 - protein, 8 aa, HIV-1
HIPLGDAR

SEQ ID NO: 4987 - protein, 8 aa, HIV-1
IPLGDARL

SEQ ID NO: 4988 - protein, 8 aa, HIV-1
PLGDARLV

SEQ ID NO: 4989 - protein, 8 aa, HIV-1
ARLVITTY

SEQ ID NO: 4990 - protein, 8 aa, HIV-1
RLVITTYW

SEQ ID NO: 4991 - protein, 8 aa, HIV-1
VITTYWGL

SEQ ID NO: 4992 - protein, 8 aa, HIV-1
TTYWGLHT

SEQ ID NO: 4993 - protein, 8 aa, HIV-1
HLGQGVSI

SEQ ID NO: 4994 - protein, 8 aa, HIV-1
QGVSIEWR

SEQ ID NO: 4995 - protein, 8 aa, HIV-1
GVSIEWRK

SEQ ID NO: 4996 - protein, 8 aa, HIV-1
VSIEWRKK

SEQ ID NO: 4997 - protein, 8 aa, HIV-1
SIEWRKKR

SEQ ID NO: 4998 - protein, 8 aa, HIV-1
TQVDPELA

SEQ ID NO: 4999 - protein, 8 aa, HIV-1
DPELADQL

SEQ ID NO: 5000 - protein, 8 aa, HIV-1
LADQLIHL

SEQ ID NO: 5001 - protein, 8 aa, HIV-1
DQLIHLYY

SEQ ID NO: 5002 - protein, 8 aa, HIV-1
QLIHLYYF

SEQ ID NO: 5003 - protein, 8 aa, HIV-1
HLYYFDCF

SEQ ID NO: 5004 - protein, 8 aa, HIV-1
DCFSDSAI

SEQ ID NO: 5005 - protein, 8 aa, HIV-1
CFSDSAIR

SEQ ID NO: 5006 - protein, 8 aa, HIV-1
FSDSAIRK

SEQ ID NO: 5007 - protein, 8 aa, HIV-1
KALLGHIV

SEQ ID NO: 5008 - protein, 8 aa, HIV-1
ALLGHIVS

SEQ ID NO: 5009 - protein, 8 aa, HIV-1
LGHIVSPR

SEQ ID NO: 5010 - protein, 8 aa, HIV-1
IVSPRCEY

SEQ ID NO: 5011 - protein, 8 aa, HIV-1
EYQAGHNK

SEQ ID NO: 5012 - protein, 8 aa, HIV-1
YQAGHNKV

SEQ ID NO: 5013 - protein, 8 aa, HIV-1
KVGSLQYL

SEQ ID NO: 5014 - protein, 8 aa, HIV-1
SLQYLALA

SEQ ID NO: 5015 - protein, 8 aa, HIV-1
LQYLALAA

SEQ ID NO: 5016 - protein, 8 aa, HIV-1
QYLALAAL

SEQ ID NO: 5017 - protein, 8 aa, HIV-1
YLALAALI

SEQ ID NO: 5018 - protein, 8 aa, HIV-1
ALAALITP

SEQ ID NO: 5019 - protein, 8 aa, HIV-1
LAALITPK

SEQ ID NO: 5020 - protein, 8 aa, HIV-1
AALITPKK

SEQ ID NO: 5021 - protein, 8 aa, HIV-1
ALITPKKI

SEQ ID NO: 5022 - protein, 8 aa, HIV-1
PLPSVTKL

SEQ ID NO: 5023 - protein, 8 aa, HIV-1
LPSVTKLT

SEQ ID NO: 5024 - protein, 8 aa, HIV-1
VTKLTEDR

SEQ ID NO: 5025 - protein, 8 aa, HIV-1
LTEDRWNK

SEQ ID NO: 5026 - protein, 8 aa, HIV-1
PQKTKGHR

SEQ ID NO: 5027 - protein, 9 aa, HIV-1
WQVMIVWQV

SEQ ID NO: 5028 - protein, 9 aa, HIV-1
VMIVWQVDR

SEQ ID NO: 5029 - protein, 9 aa, HIV-1
MIVWQVDRM

SEQ ID NO: 5030 - protein, 9 aa, HIV-1
IVWQVDRMR

SEQ ID NO: 5031 - protein, 9 aa, HIV-1
VWQVDRMRI

SEQ ID NO: 5032 - protein, 9 aa, HIV-1
WQVDRMRIR

SEQ ID NO: 5033 - protein, 9 aa, HIV-1
RMRIRTWKS

SEQ ID NO: 5034 - protein, 9 aa, HIV-1
RIRTWKSLV

SEQ ID NO: 5035 - protein, 9 aa, HIV-1
IRTWKSLVK

SEQ ID NO: 5036 - protein, 9 aa, HIV-1
RTWKSLVKH

SEQ ID NO: 5037 - protein, 9 aa, HIV-1
KSLVKHHMY

SEQ ID NO: 5038 - protein, 9 aa, HIV-1
SLVKHHMYV

SEQ ID NO: 5039 - protein, 9 aa, HIV-1
KHHMYVSGK

SEQ ID NO: 5040 - protein, 9 aa, HIV-1
HMYVSGKAR

SEQ ID NO: 5041 - protein, 9 aa, HIV-1
SGKARGWFY

SEQ ID NO: 5042 - protein, 9 aa, HIV-1
KARGWFYRH

SEQ ID NO: 5043 - protein, 9 aa, HIV-1
RGWFYRHHY

SEQ ID NO: 5044 - protein, 9 aa, HIV-1
HHYESPHPR

SEQ ID NO: 5045 - protein, 9 aa, HIV-1
SPHPRISSE

SEQ ID NO: 5046 - protein, 9 aa, HIV-1
HPRISSEVH

SEQ ID NO: 5047 - protein, 9 aa, HIV-1
ISSEVHIPL

SEQ ID NO: 5048 - protein, 9 aa, HIV-1
SEVHIPLGD

SEQ ID NO: 5049 - protein, 9 aa, HIV-1
HIPLGDARL

SEQ ID NO: 5050 - protein, 9 aa, HIV-1
IPLGDARLV

SEQ ID NO: 5051 - protein, 9 aa, HIV-1
PLGDARLVI

SEQ ID NO: 5052 - protein, 9 aa, HIV-1
DARLVITTY

SEQ ID NO: 5053 - protein, 9 aa, HIV-1
LVITTYWGL

SEQ ID NO: 5054 - protein, 9 aa, HIV-1
WHLGQGVSI

SEQ ID NO: 5055 - protein, 9 aa, HIV-1
LGQGVSIEW

SEQ ID NO: 5056 - protein, 9 aa, HIV-1
GQGVSIEWR

SEQ ID NO: 5057 - protein, 9 aa, HIV-1
GVSIEWRKK

SEQ ID NO: 5058 - protein, 9 aa, HIV-1
VSIEWRKKR

SEQ ID NO: 5059 - protein, 9 aa, HIV-1
ELADQLIHL

SEQ ID NO: 5060 - protein, 9 aa, HIV-1
LADQLIHLY

SEQ ID NO: 5061 - protein, 9 aa, HIV-1
DQLIHLYYF

SEQ ID NO: 5062 - protein, 9 aa, HIV-1
IHLYYFDCF

SEQ ID NO: 5063 - protein, 9 aa, HIV-1
HLYYFDCFS

SEQ ID NO: 5064 - protein, 9 aa, HIV-1
DCFSDSAIR

SEQ ID NO: 5065 - protein, 9 aa, HIV-1
ALLGHIVSP

SEQ ID NO: 5066 - protein, 9 aa, HIV-1
LLGHIVSPR

SEQ ID NO: 5067 - protein, 9 aa, HIV-1
HIVSPRCEY

SEQ ID NO: 5068 - protein, 9 aa, HIV-1
KVGSLQYLA

SEQ ID NO: 5069 - protein, 9 aa, HIV-1
SLQYLALAA

SEQ ID NO: 5070 - protein, 9 aa, HIV-1
LQYLALAAL

SEQ ID NO: 5071 - protein, 9 aa, HIV-1
QYLALAALI

SEQ ID NO: 5072 - protein, 9 aa, HIV-1
YLALAALIT

SEQ ID NO: 5073 - protein, 9 aa, HIV-1
ALAALITPK

SEQ ID NO: 5074 - protein, 9 aa, HIV-1
LAALITPKK

SEQ ID NO: 5075 - protein, 9 aa, HIV-1
ALITPKKIK

SEQ ID NO: 5076 - protein, 9 aa, HIV-1
TPKKIKPPL

SEQ ID NO: 5077 - protein, 9 aa, HIV-1
KIKPPLPSV

SEQ ID NO: 5078 - protein, 9 aa, HIV-1
SVTKLTEDR

SEQ ID NO: 5079 - protein, 9 aa, HIV-1
VTKLTEDRW

SEQ ID NO: 5080 - protein, 9 aa, HIV-1
KLTEDRWNK

SEQ ID NO: 5081 - protein, 9 aa, HIV-1
RWNKPQKTK

SEQ ID NO: 5082 - protein, 9 aa, HIV-1
KPQKTKGHR

SEQ ID NO: 5083 - protein, 9 aa, HIV-1
KTKGHRGSH

SEQ ID NO: 5084 - protein, 10 aa, HIV-1
MENRWQVMIV

SEQ ID NO: 5085 - protein, 10 aa, HIV-1
RWQVMIVWQV

SEQ ID NO: 5086 - protein, 10 aa, HIV-1
QVMIVWQVDR

SEQ ID NO: 5087 - protein, 10 aa, HIV-1
VMIVWQVDRM

SEQ ID NO: 5088 - protein, 10 aa, HIV-1
MIVWQVDRMR

SEQ ID NO: 5089 - protein, 10 aa, HIV-1
IVWQVDRMRI

SEQ ID NO: 5090 - protein, 10 aa, HIV-1
VWQVDRMRIR

SEQ ID NO: 5091 - protein, 10 aa, HIV-1
WQVDRMRIRT

SEQ ID NO: 5092 - protein, 10 aa, HIV-1
RMRIRTWKSL

SEQ ID NO: 5093 - protein, 10 aa, HIV-1
RIRTWKSLVK

SEQ ID NO: 5094 - protein, 10 aa, HIV-1
KSLVKHHMYV

SEQ ID NO: 5095 - protein, 10 aa, HIV-1
SLVKHHMYVS

SEQ ID NO: 5096 - protein, 10 aa, HIV-1
MYVSGKARGW

SEQ ID NO: 5097 - protein, 10 aa, HIV-1
YVSGKARGWF

SEQ ID NO: 5098 - protein, 10 aa, HIV-1
VSGKARGWFY

SEQ ID NO: 5099 - protein, 10 aa, HIV-1
SGKARGWFYR

SEQ ID NO: 5100 - protein, 10 aa, HIV-1
RHHYESPHPR

SEQ ID NO: 5101 - protein, 10 aa, HIV-1
HHYESPHPRI

SEQ ID NO: 5102 - protein, 10 aa, HIV-1
YESPHPRISS

SEQ ID NO: 5103 - protein, 10 aa, HIV-1
SPHPRISSEV

SEQ ID NO: 5104 - protein, 10 aa, HIV-1
HPRISSEVHI

SEQ ID NO: 5105 - protein, 10 aa, HIV-1
RISSEVHIPL

SEQ ID NO: 5106 - protein, 10 aa, HIV-1
EVHIPLGDAR

SEQ ID NO: 5107 - protein, 10 aa, HIV-1
HIPLGDARLV

SEQ ID NO: 5108 - protein, 10 aa, HIV-1
IPLGDARLVI

SEQ ID NO: 5109 - protein, 10 aa, HIV-1
PLGDARLVIT

SEQ ID NO: 5110 - protein, 10 aa, HIV-1
RLVITTYWGL

SEQ ID NO: 5111 - protein, 10 aa, HIV-1
TTYWGLHTGE

SEQ ID NO: 5112 - protein, 10 aa, HIV-1
TYWGLHTGER

SEQ ID NO: 5113 - protein, 10 aa, HIV-1
HLGQGVSIEW

SEQ ID NO: 5114 - protein, 10 aa, HIV-1
GQGVSIEWRK

SEQ ID NO: 5115 - protein, 10 aa, HIV-1
GVSIEWRKKR

SEQ ID NO: 5116 - protein, 10 aa, HIV-1
VSIEWRKKRY

SEQ ID NO: 5117 - protein, 10 aa, HIV-1
RYSTQVDPEL

SEQ ID NO: 5118 - protein, 10 aa, HIV-1
QVDPELADQL

SEQ ID NO: 5119 - protein, 10 aa, HIV-1
DPELADQLIH

SEQ ID NO: 5120 - protein, 10 aa, HIV-1
PELADQLIHL

SEQ ID NO: 5121 - protein, 10 aa, HIV-1
ELADQLIHLY

SEQ ID NO: 5122 - protein, 10 aa, HIV-1
LADQLIHLYY

SEQ ID NO: 5123 - protein, 10 aa, HIV-1
YYFDCFSDSA

SEQ ID NO: 5124 - protein, 10 aa, HIV-1
YFDCFSDSAI

SEQ ID NO: 5125 - protein, 10 aa, HIV-1
FDCFSDSAIR

SEQ ID NO: 5126 - protein, 10 aa, HIV-1
AIRKALLGHI

SEQ ID NO: 5127 - protein, 10 aa, HIV-1
ALLGHIVSPR

SEQ ID NO: 5128 - protein, 10 aa, HIV-1
LLGHIVSPRC

SEQ ID NO: 5129 - protein, 10 aa, HIV-1
IVSPRCEYQA

SEQ ID NO: 5130 - protein, 10 aa, HIV-1
CEYQAGHNKV

SEQ ID NO: 5131 - protein, 10 aa, HIV-1
KVGSLQYLAL

SEQ ID NO: 5132 - protein, 10 aa, HIV-1
SLQYLALAAL

SEQ ID NO: 5133 - protein, 10 aa, HIV-1
LQYLALAALI

SEQ ID NO: 5134 - protein, 10 aa, HIV-1
YLALAALITP

SEQ ID NO: 5135 - protein, 10 aa, HIV-1
LALAALITPK

SEQ ID NO: 5136 - protein, 10 aa, HIV-1
ALAALITPKK

SEQ ID NO: 5137 - protein, 10 aa, HIV-1
AALITPKKIK

SEQ ID NO: 5138 - protein, 10 aa, HIV-1
KKIKPPLPSV

SEQ ID NO: 5139 - protein, 10 aa, HIV-1
KPPLPSVTKL

SEQ ID NO: 5140 - protein, 10 aa, HIV-1
KTKGHRGSHT

SEQ ID NO: 5141 - protein, 11 aa, HIV-1
MENRWQVMIVW

SEQ ID NO: 5142 - protein, 11 aa, HIV-1
NRWQVMIVWQV

SEQ ID NO: 5143 - protein, 11 aa, HIV-1
WQVMIVWQVDR

SEQ ID NO: 5144 - protein, 11 aa, HIV-1
QVMIVWQVDRM

SEQ ID NO: 5145 - protein, 11 aa, HIV-1
VMIVWQVDRMR

SEQ ID NO: 5146 - protein, 11 aa, HIV-1
MIVWQVDRMRI

SEQ ID NO: 5147 - protein, 11 aa, HIV-1
IVWQVDRMRIR

SEQ ID NO: 5148 - protein, 11 aa, HIV-1
WQVDRMRIRTW

SEQ ID NO: 5149 - protein, 11 aa, HIV-1
QVDRMRIRTWK

SEQ ID NO: 5150 - protein, 11 aa, HIV-1
RMRIRTWKSLV

SEQ ID NO: 5151 - protein, 11 aa, HIV-1
MRIRTWKSLVK

SEQ ID NO: 5152 - protein, 11 aa, HIV-1
RIRTWKSLVKH

SEQ ID NO: 5153 - protein, 11 aa, HIV-1
RTWKSLVKHHM

SEQ ID NO: 5154 - protein, 11 aa, HIV-1
TWKSLVKHHMY

SEQ ID NO: 5155 - protein, 11 aa, HIV-1
WKSLVKHHMYV

SEQ ID NO: 5156 - protein, 11 aa, HIV-1
LVKHHMYVSGK

SEQ ID NO: 5157 - protein, 11 aa, HIV-1
KHHMYVSGKAR

SEQ ID NO: 5158 - protein, 11 aa, HIV-1
HMYVSGKARGW

SEQ ID NO: 5159 - protein, 11 aa, HIV-1
MYVSGKARGWF

SEQ ID NO: 5160 - protein, 11 aa, HIV-1
YVSGKARGWFY

SEQ ID NO: 5161 - protein, 11 aa, HIV-1
VSGKARGWFYR

SEQ ID NO: 5162 - protein, 11 aa, HIV-1
KARGWFYRHHY

SEQ ID NO: 5163 - protein, 11 aa, HIV-1
ESPHPRISSEV

SEQ ID NO: 5164 - protein, 11 aa, HIV-1
EVHIPLGDARL

SEQ ID NO: 5165 - protein, 11 aa, HIV-1
IPLGDARLVIT

SEQ ID NO: 5166 - protein, 11 aa, HIV-1
PLGDARLVITT

SEQ ID NO: 5167 - protein, 11 aa, HIV-1
ARLVITTYWGL

SEQ ID NO: 5168 - protein, 11 aa, HIV-1
RLVITTYWGLH

SEQ ID NO: 5169 - protein, 11 aa, HIV-1
LVITTYWGLHT

SEQ ID NO: 5170 - protein, 11 aa, HIV-1
TTYWGLHTGER

SEQ ID NO: 5171 - protein, 11 aa, HIV-1
YWGLHTGERDW

SEQ ID NO: 5172 - protein, 11 aa, HIV-1
GLHTGERDWHL

SEQ ID NO: 5173 - protein, 11 aa, HIV-1
WHLGQGVSIEW

SEQ ID NO: 5174 - protein, 11 aa, HIV-1
HLGQGVSIEWR

SEQ ID NO: 5175 - protein, 11 aa, HIV-1
KRYSTQVDPEL

SEQ ID NO: 5176 - protein, 11 aa, HIV-1
TQVDPELADQL

SEQ ID NO: 5177 - protein, 11 aa, HIV-1
QVDPELADQLI

SEQ ID NO: 5178 - protein, 11 aa, HIV-1
DPELADQLIHL

SEQ ID NO: 5179 - protein, 11 aa, HIV-1
PELADQLIHLY

SEQ ID NO: 5180 - protein, 11 aa, HIV-1
ELADQLIHLYY

SEQ ID NO: 5181 - protein, 11 aa, HIV-1
LADQLIHLYYF

SEQ ID NO: 5182 - protein, 11 aa, HIV-1
QLIHLYYFDCF

SEQ ID NO: 5183 - protein, 11 aa, HIV-1
YYFDCFSDSAI

SEQ ID NO: 5184 - protein, 11 aa, HIV-1
AIRKALLGHIV

SEQ ID NO: 5185 - protein, 11 aa, HIV-1
KALLGHIVSPR

SEQ ID NO: 5186 - protein, 11 aa, HIV-1
ALLGHIVSPRC

SEQ ID NO: 5187 - protein, 11 aa, HIV-1
HIVSPRCEYQA

SEQ ID NO: 5188 - protein, 11 aa, HIV-1
YQAGHNKVGSL

SEQ ID NO: 5189 - protein, 11 aa, HIV-1
KVGSLQYLALA

SEQ ID NO: 5190 - protein, 11 aa, HIV-1
GSLQYLALAAL

SEQ ID NO: 5191 - protein, 11 aa, HIV-1
SLQYLALAALI

SEQ ID NO: 5192 - protein, 11 aa, HIV-1
LQYLALAALIT

SEQ ID NO: 5193 - protein, 11 aa, HIV-1
YLALAALITPK

SEQ ID NO: 5194 - protein, 11 aa, HIV-1
LALAALITPKK

SEQ ID NO: 5195 - protein, 11 aa, HIV-1
ALAALITPKKI

SEQ ID NO: 5196 - protein, 11 aa, HIV-1
LAALITPKKIK

SEQ ID NO: 5197 - protein, 11 aa, HIV-1
LITPKKIKPPL

SEQ ID NO: 5198 - protein, 11 aa, HIV-1
KIKPPLPSVTK

SEQ ID NO: 5199 - protein, 11 aa, HIV-1
VTKLTEDRWNK

SEQ ID NO: 5200 - protein, 11 aa, HIV-1
KLTEDRWNKPQ

SEQ ID NO: 5201 - protein, 11 aa, HIV-1
LTEDRWNKPQK

SEQ ID NO: 5202 - protein, 11 aa, HIV-1
KTKGHRGSHTM

SEQ ID NO: 5203 - protein, 15 aa, HIV-1
ADQLIHLYYFDCFSD

SEQ ID NO: 5204 - protein, 9 aa, HIV-1
IHLYYFDCF

SEQ ID NO: 5205 - protein, 15 aa, HIV-1
AGHNKVGSLQYLALA

SEQ ID NO: 5206 - protein, 9 aa, HIV-1
VGSLQYLAL

SEQ ID NO: 5207 - protein, 15 aa, HIV-1
AIRKALLGHIVSPRC

SEQ ID NO: 5208 - protein, 9 aa, HIV-1
LLGHIVSPR

SEQ ID NO: 5209 - protein, 15 aa, HIV-1
AIRKALLGHIVSPRC

SEQ ID NO: 5210 - protein, 9 aa, HIV-1
RKALLGHIV

SEQ ID NO: 5211 - protein, 15 aa, HIV-1
ALLGHIVSPRCEYQA

SEQ ID NO: 5212 - protein, 9 aa, HIV-1
LLGHIVSPR

SEQ ID NO: 5213 - protein, 15 aa, HIV-1
ARLVITTYWGLHTGE

SEQ ID NO: 5214 - protein, 9 aa, HIV-1
LVITTYWGL

SEQ ID NO: 5215 - protein, 15 aa, HIV-1
ARLVITTYWGLHTGE

SEQ ID NO: 5216 - protein, 9 aa, HIV-1
VITTYWGLH

SEQ ID NO: 5217 - protein, 15 aa, HIV-1
CEYQAGHNKVGSLQY

SEQ ID NO: 5218 - protein, 9 aa, HIV-1
YQAGHNKVG

SEQ ID NO: 5219 - protein, 15 aa, HIV-1
CFSDSAIRKALLGHI

SEQ ID NO: 5220 - protein, 9 aa, HIV-1
AIRKALLGH

SEQ ID NO: 5221 - protein, 15 aa, HIV-1
DARLVITTYWGLHTG

SEQ ID NO: 5222 - protein, 9 aa, HIV-1
LVITTYWGL

SEQ ID NO: 5223 - protein, 15 aa, HIV-1
DARLVITTYWGLHTG

SEQ ID NO: 5224 - protein, 9 aa, HIV-1
VITTYWGLH

SEQ ID NO: 5225 - protein, 15 aa, HIV-1
DQLIHLYYFDCFSDS

SEQ ID NO: 5226 - protein, 9 aa, HIV-1
IHLYYFDCF

SEQ ID NO: 5227 - protein, 15 aa, HIV-1
DRMRIRTWKSLVKHH

SEQ ID NO: 5228 - protein, 9 aa, HIV-1
IRTWKSLVK

SEQ ID NO: 5229 - protein, 15 aa, HIV-1
DSAIRKALLGHIVSP

SEQ ID NO: 5230 - protein, 9 aa, HIV-1
AIRKALLGH

SEQ ID NO: 5231 - protein, 15 aa, HIV-1
DSAIRKALLGHIVSP

SEQ ID NO: 5232 - protein, 9 aa, HIV-1
IRKALLGHI

SEQ ID NO: 5233 - protein, 15 aa, HIV-1
DWHLGQGVSIEWRKK

SEQ ID NO: 5234 - protein, 9 aa, HIV-1
LGQGVSIEW

SEQ ID NO: 5235 - protein, 15 aa, HIV-1
ELADQLIHLYYFDCF

SEQ ID NO: 5236 - protein, 9 aa, HIV-1
LIHLYYFDC

SEQ ID NO: 5237 - protein, 15 aa, HIV-1
ENRWQVMIVWQVDRM

SEQ ID NO: 5238 - protein, 9 aa, HIV-1
NRWQVMIVW

SEQ ID NO: 5239 - protein, 15 aa, HIV-1
ENRWQVMIVWQVDRM

SEQ ID NO: 5240 - protein, 9 aa, HIV-1
VMIVWQVDR

SEQ ID NO: 5241 - protein, 15 aa, HIV-1
ENRWQVMIVWQVDRM

SEQ ID NO: 5242 - protein, 9 aa, HIV-1
WQVMIVWQV

SEQ ID NO: 5243 - protein, 15 aa, HIV-1
ERDWHLGQGVSIEWR

SEQ ID NO: 5244 - protein, 9 aa, HIV-1
WHLGQGVSI

SEQ ID NO: 5245 - protein, 15 aa, HIV-1
EVHIPLGDARLVITT

SEQ ID NO: 5246 - protein, 9 aa, HIV-1
IPLGDARLV

SEQ ID NO: 5247 - protein, 15 aa, HIV-1
EYQAGHNKVGSLQYL

SEQ ID NO: 5248 - protein, 9 aa, HIV-1
YQAGHNKVG

SEQ ID NO: 5249 - protein, 15 aa, HIV-1
FSDSAIRKALLGHIV

SEQ ID NO: 5250 - protein, 9 aa, HIV-1
AIRKALLGH

SEQ ID NO: 5251 - protein, 15 aa, HIV-1
FSDSAIRKALLGHIV

SEQ ID NO: 5252 - protein, 9 aa, HIV-1
IRKALLGHI

SEQ ID NO: 5253 - protein, 15 aa, HIV-1
FYRHHYESPHPRISS

SEQ ID NO: 5254 - protein, 9 aa, HIV-1
YESPHPRIS

SEQ ID NO: 5255 - protein, 15 aa, HIV-1
GDARLVITTYWGLHT

SEQ ID NO: 5256 - protein, 9 aa, HIV-1
LVITTYWGL

SEQ ID NO: 5257 - protein, 15 aa, HIV-1
GDARLVITTYWGLHT

SEQ ID NO: 5258 - protein, 9 aa, HIV-1
VITTYWGLH

SEQ ID NO: 5259 - protein, 15 aa, HIV-1
GERDWHLGQGVSIEW

SEQ ID NO: 5260 - protein, 9 aa, HIV-1
WHLGQGVSI

SEQ ID NO: 5261 - protein, 15 aa, HIV-1
GHNKVGSLQYLALAA

SEQ ID NO: 5262 - protein, 9 aa, HIV-1
VGSLQYLAL

SEQ ID NO: 5263 - protein, 15 aa, HIV-1
GQGVSIEWRKKRYST

SEQ ID NO: 5264 - protein, 9 aa, HIV-1
VSIEWRKKR

SEQ ID NO: 5265 - protein, 15 aa, HIV-1
GSLQYLALAALITPK

SEQ ID NO: 5266 - protein, 9 aa, HIV-1
LALAALITP

SEQ ID NO: 5267 - protein, 15 aa, HIV-1
GSLQYLALAALITPK

SEQ ID NO: 5268 - protein, 9 aa, HIV-1
YLALAALIT

SEQ ID NO: 5269 - protein, 15 aa, HIV-1
GVSIEWRKKRYSTQV

SEQ ID NO: 5270 - protein, 9 aa, HIV-1
IEWRKKRYS

SEQ ID NO: 5271 - protein, 15 aa, HIV-1
GVSIEWRKKRYSTQV

SEQ ID NO: 5272 - protein, 9 aa, HIV-1
VSIEWRKKR

SEQ ID NO: 5273 - protein, 15 aa, HIV-1
GVSIEWRKKRYSTQV

SEQ ID NO: 5274 - protein, 9 aa, HIV-1
WRKKRYSTQ

SEQ ID NO: 5275 - protein, 15 aa, HIV-1
HHMYVSGKARGWFYR

SEQ ID NO: 5276 - protein, 9 aa, HIV-1
YVSGKARGW

SEQ ID NO: 5277 - protein, 15 aa, HIV-1
HHYESPHPRISSEVH

SEQ ID NO: 5278 - protein, 9 aa, HIV-1
YESPHPRIS

SEQ ID NO: 5279 - protein, 15 aa, HIV-1
HIPLGDARLVITTYW

SEQ ID NO: 5280 - protein, 9 aa, HIV-1
LGDARLVIT

SEQ ID NO: 5281 - protein, 15 aa, HIV-1
HLGQGVSIEWRKKRY

SEQ ID NO: 5282 - protein, 9 aa, HIV-1
VSIEWRKKR

SEQ ID NO: 5283 - protein, 15 aa, HIV-1
HMYVSGKARGWFYRH

SEQ ID NO: 5284 - protein, 9 aa, HIV-1
YVSGKARGW

SEQ ID NO: 5285 - protein, 15 aa, HIV-1
HNKVGSLQYLALAAL

SEQ ID NO: 5286 - protein, 9 aa, HIV-1
VGSLQYLAL

SEQ ID NO: 5287 - protein, 15 aa, HIV-1
IEWRKKRYSTQVDPE

SEQ ID NO: 5288 - protein, 9 aa, HIV-1
WRKKRYSTQ

SEQ ID NO: 5289 - protein, 15 aa, HIV-1
IKPPLPSVTKLTEDR

SEQ ID NO: 5290 - protein, 9 aa, HIV-1
IKPPLPSVT

SEQ ID NO: 5291 - protein, 15 aa, HIV-1
IPLGDARLVITTYWG

SEQ ID NO: 5292 - protein, 9 aa, HIV-1
LGDARLVIT

SEQ ID NO: 5293 - protein, 15 aa, HIV-1
IRKALLGHIVSPRCE

SEQ ID NO: 5294 - protein, 9 aa, HIV-1
LGHIVSPRC

SEQ ID NO: 5295 - protein, 15 aa, HIV-1
IRKALLGHIVSPRCE

SEQ ID NO: 5296 - protein, 9 aa, HIV-1
LLGHIVSPR

SEQ ID NO: 5297 - protein, 15 aa, HIV-1
IRTWKSLVKHHMYVS

SEQ ID NO: 5298 - protein, 9 aa, HIV-1
IRTWKSLVK

SEQ ID NO: 5299 - protein, 15 aa, HIV-1
IRTWKSLVKHHMYVS

SEQ ID NO: 5300 - protein, 9 aa, HIV-1
WKSLVKHHM

SEQ ID NO: 5301 - protein, 15 aa, HIV-1
ISSEVHIPLGDARLV

SEQ ID NO: 5302 - protein, 9 aa, HIV-1
HIPLGDARL

SEQ ID NO: 5303 - protein, 15 aa, HIV-1
ITPKKIKPPLPSVTK

SEQ ID NO: 5304 - protein, 9 aa, HIV-1
IKPPLPSVT

SEQ ID NO: 5305 - protein, 15 aa, HIV-1
ITTYWGLHTGERDWH

SEQ ID NO: 5306 - protein, 9 aa, HIV-1
YWGLHTGER

SEQ ID NO: 5307 - protein, 15 aa, HIV-1
IVWQVDRMRIRTWKS

SEQ ID NO: 5308 - protein, 9 aa, HIV-1
VDRMRIRTW

SEQ ID NO: 5309 - protein, 15 aa, HIV-1
IVWQVDRMRIRTWKS

SEQ ID NO: 5310 - protein, 9 aa, HIV-1
WQVDRMRIR

SEQ ID NO: 5311 - protein, 15 aa, HIV-1
KALLGHIVSPRCEYQ

SEQ ID NO: 5312 - protein, 9 aa, HIV-1
LLGHIVSPR

SEQ ID NO: 5313 - protein, 15 aa, HIV-1
KHHMYVSGKARGWFY

SEQ ID NO: 5314 - protein, 9 aa, HIV-1
YVSGKARGW

SEQ ID NO: 5315 - protein, 15 aa, HIV-1
KIKPPLPSVTKLTED

SEQ ID NO: 5316 - protein, 9 aa, HIV-1
IKPPLPSVT

SEQ ID NO: 5317 - protein, 15 aa, HIV-1
KKIKPPLPSVTKLTE

SEQ ID NO: 5318 - protein, 9 aa, HIV-1
IKPPLPSVT

SEQ ID NO: 5319 - protein, 15 aa, HIV-1
KKRYSTQVDPELADQ

SEQ ID NO: 5320 - protein, 9 aa, HIV-1
TQVDPELAD

SEQ ID NO: 5321 - protein, 15 aa, HIV-1
KSLVKHHMYVSGKAR

SEQ ID NO: 5322 - protein, 9 aa, HIV-1
VKHHMYVSG

SEQ ID NO: 5323 - protein, 15 aa, HIV-1
KVGSLQYLALAALIT

SEQ ID NO: 5324 - protein, 9 aa, HIV-1
LQYLALAAL

SEQ ID NO: 5325 - protein, 15 aa, HIV-1
KVGSLQYLALAALIT

SEQ ID NO: 5326 - protein, 9 aa, HIV-1
QYLALAALI

SEQ ID NO: 5327 - protein, 15 aa, HIV-1
LADQLIHLYYFDCFS

SEQ ID NO: 5328 - protein, 9 aa, HIV-1
IHLYYFDCF

SEQ ID NO: 5329 - protein, 15 aa, HIV-1
LALAALITPKKIKPP

SEQ ID NO: 5330 - protein, 9 aa, HIV-1
LAALITPKK

SEQ ID NO: 5331 - protein, 15 aa, HIV-1
LGDARLVITTYWGLH

SEQ ID NO: 5332 - protein, 9 aa, HIV-1
LGDARLVIT

SEQ ID NO: 5333 - protein, 15 aa, HIV-1
LGDARLVITTYWGLH

SEQ ID NO: 5334 - protein, 9 aa, HIV-1
LVITTYWGL

SEQ ID NO: 5335 - protein, 15 aa, HIV-1
LGQGVSIEWRKKRYS

SEQ ID NO: 5336 - protein, 9 aa, HIV-1
VSIEWRKKR

SEQ ID NO: 5337 - protein, 15 aa, HIV-1
LITPKKIKPPLPSVT

SEQ ID NO: 5338 - protein, 9 aa, HIV-1
KKIKPPLPS

SEQ ID NO: 5339 - protein, 15 aa, HIV-1
LITPKKIKPPLPSVT

SEQ ID NO: 5340 - protein, 9 aa, HIV-1
PKKIKPPLP

SEQ ID NO: 5341 - protein, 15 aa, HIV-1
LLGHIVSPRCEYQAG

SEQ ID NO: 5342 - protein, 9 aa, HIV-1
LLGHIVSPR

SEQ ID NO: 5343 - protein, 15 aa, HIV-1
LQYLALAALITPKKI

SEQ ID NO: 5344 - protein, 9 aa, HIV-1
LALAALITP

SEQ ID NO: 5345 - protein, 15 aa, HIV-1
LQYLALAALITPKKI

SEQ ID NO: 5346 - protein, 9 aa, HIV-1
LAALITPKK

SEQ ID NO: 5347 - protein, 15 aa, HIV-1
LQYLALAALITPKKI

SEQ ID NO: 5348 - protein, 9 aa, HIV-1
YLALAALIT

SEQ ID NO: 5349 - protein, 15 aa, HIV-1
LVITTYWGLHTGERD

SEQ ID NO: 5350 - protein, 9 aa, HIV-1
VITTYWGLH

SEQ ID NO: 5351 - protein, 15 aa, HIV-1
LVITTYWGLHTGERD

SEQ ID NO: 5352 - protein, 9 aa, HIV-1
YWGLHTGER

SEQ ID NO: 5353 - protein, 15 aa, HIV-1
LVKHHMYVSGKARGW

SEQ ID NO: 5354 - protein, 9 aa, HIV-1
VKHHMYVSG

SEQ ID NO: 5355 - protein, 15 aa, HIV-1
MENRWQVMIVWQVDR

SEQ ID NO: 5356 - protein, 9 aa, HIV-1
WQVMIVWQV

SEQ ID NO: 5357 - protein, 15 aa, HIV-1
MIVWQVDRMRIRTWK

SEQ ID NO: 5358 - protein, 9 aa, HIV-1
IVWQVDRMR

SEQ ID NO: 5359 - protein, 15 aa, HIV-1
MIVWQVDRMRIRTWK

SEQ ID NO: 5360 - protein, 9 aa, HIV-1
MIVWQVDRM

SEQ ID NO: 5361 - protein, 15 aa, HIV-1
MIVWQVDRMRIRTWK

SEQ ID NO: 5362 - protein, 9 aa, HIV-1
WQVDRMRIR

SEQ ID NO: 5363 - protein, 15 aa, HIV-1
MRIRTWKSLVKHHMY

SEQ ID NO: 5364 - protein, 9 aa, HIV-1
IRTWKSLVK

SEQ ID NO: 5365 - protein, 15 aa, HIV-1
MRIRTWKSLVKHHMY

SEQ ID NO: 5366 - protein, 9 aa, HIV-1
WKSLVKHHM

SEQ ID NO: 5367 - protein, 15 aa, HIV-1
MYVSGKARGWFYRHH

SEQ ID NO: 5368 - protein, 9 aa, HIV-1
GKARGWFYR

SEQ ID NO: 5369 - protein, 15 aa, HIV-1
MYVSGKARGWFYRHH

SEQ ID NO: 5370 - protein, 9 aa, HIV-1
YVSGKARGW

SEQ ID NO: 5371 - protein, 15 aa, HIV-1
NKVGSLQYLALAALI

SEQ ID NO: 5372 - protein, 9 aa, HIV-1
LQYLALAAL

SEQ ID NO: 5373 - protein, 15 aa, HIV-1
NRWQVMIVWQVDRMR

SEQ ID NO: 5374 - protein, 9 aa, HIV-1
MIVWQVDRM

SEQ ID NO: 5375 - protein, 15 aa, HIV-1
NRWQVMIVWQVDRMR

SEQ ID NO: 5376 - protein, 9 aa, HIV-1
WQVMIVWQV

SEQ ID NO: 5377 - protein, 15 aa, HIV-1
PKKIKPPLPSVTKLT

SEQ ID NO: 5378 - protein, 9 aa, HIV-1
IKPPLPSVT

SEQ ID NO: 5379 - protein, 15 aa, HIV-1
PLGDARLVITTYWGL

SEQ ID NO: 5380 - protein, 9 aa, HIV-1
ARLVITTYW

SEQ ID NO: 5381 - protein, 15 aa, HIV-1
PLGDARLVITTYWGL

SEQ ID NO: 5382 - protein, 9 aa, HIV-1
LGDARLVIT

SEQ ID NO: 5383 - protein, 15 aa, HIV-1
PRCEYQAGHNKVGSL

SEQ ID NO: 5384 - protein, 9 aa, HIV-1
YQAGHNKVG

SEQ ID NO: 5385 - protein, 15 aa, HIV-1
QAGHNKVGSLQYLAL

SEQ ID NO: 5386 - protein, 9 aa, HIV-1
NKVGSLQYL

SEQ ID NO: 5387 - protein, 15 aa, HIV-1
QGVSIEWRKKRYSTQ

SEQ ID NO: 5388 - protein, 9 aa, HIV-1
IEWRKKRYS

SEQ ID NO: 5389 - protein, 15 aa, HIV-1
QGVSIEWRKKRYSTQ

SEQ ID NO: 5390 - protein, 9 aa, HIV-1
SIEWRKKRY

SEQ ID NO: 5391 - protein, 15 aa, HIV-1
QGVSIEWRKKRYSTQ

SEQ ID NO: 5392 - protein, 9 aa, HIV-1
VSIEWRKKR

SEQ ID NO: 5393 - protein, 15 aa, HIV-1
QLIHLYYFDCFSDSA

SEQ ID NO: 5394 - protein, 9 aa, HIV-1
IHLYYFDCF

SEQ ID NO: 5395 - protein, 15 aa, HIV-1
QVDRMRIRTWKSLVK

SEQ ID NO: 5396 - protein, 9 aa, HIV-1
DRMRIRTWK

SEQ ID NO: 5397 - protein, 15 aa, HIV-1
QVDRMRIRTWKSLVK

SEQ ID NO: 5398 - protein, 9 aa, HIV-1
MRIRTWKSL

SEQ ID NO: 5399 - protein, 15 aa, HIV-1
QVDRMRIRTWKSLVK

SEQ ID NO: 5400 - protein, 9 aa, HIV-1
RMRIRTWKS

SEQ ID NO: 5401 - protein, 15 aa, HIV-1
QVMIVWQVDRMRIRT

SEQ ID NO: 5402 - protein, 9 aa, HIV-1
IVWQVDRMR

SEQ ID NO: 5403 - protein, 15 aa, HIV-1
QVMIVWQVDRMRIRT

SEQ ID NO: 5404 - protein, 9 aa, HIV-1
MIVWQVDRM

SEQ ID NO: 5405 - protein, 15 aa, HIV-1
QYLALAALITPKKIK

SEQ ID NO: 5406 - protein, 9 aa, HIV-1
LALAALITP

SEQ ID NO: 5407 - protein, 15 aa, HIV-1
QYLALAALITPKKIK

SEQ ID NO: 5408 - protein, 9 aa, HIV-1
LAALITPKK

SEQ ID NO: 5409 - protein, 15 aa, HIV-1
QYLALAALITPKKIK

SEQ ID NO: 5410 - protein, 9 aa, HIV-1
YLALAALIT

SEQ ID NO: 5411 - protein, 15 aa, HIV-1
RCEYQAGHNKVGSLQ

SEQ ID NO: 5412 - protein, 9 aa, HIV-1
YQAGHNKVG

SEQ ID NO: 5413 - protein, 15 aa, HIV-1
RDWHLGQGVSIEWRK

SEQ ID NO: 5414 - protein, 9 aa, HIV-1
WHLGQGVSI

SEQ ID NO: 5415 - protein, 15 aa, HIV-1
RHHYESPHPRISSEV

SEQ ID NO: 5416 - protein, 9 aa, HIV-1
YESPHPRIS

SEQ ID NO: 5417 - protein, 15 aa, HIV-1
RIRTWKSLVKHHMYV

SEQ ID NO: 5418 - protein, 9 aa, HIV-1
IRTWKSLVK

SEQ ID NO: 5419 - protein, 15 aa, HIV-1
RIRTWKSLVKHHMYV

SEQ ID NO: 5420 - protein, 9 aa, HIV-1
WKSLVKHHM

SEQ ID NO: 5421 - protein, 15 aa, HIV-1
RKALLGHIVSPRCEY

SEQ ID NO: 5422 - protein, 9 aa, HIV-1
LGHIVSPRC

SEQ ID NO: 5423 - protein, 15 aa, HIV-1
RKALLGHIVSPRCEY

SEQ ID NO: 5424 - protein, 9 aa, HIV-1
LLGHIVSPR

SEQ ID NO: 5425 - protein, 15 aa, HIV-1
RKKRYSTQVDPELAD

SEQ ID NO: 5426 - protein, 9 aa, HIV-1
KKRYSTQVD

SEQ ID NO: 5427 - protein, 15 aa, HIV-1
RLVITTYWGLHTGER

SEQ ID NO: 5428 - protein, 9 aa, HIV-1
ITTYWGLHT

SEQ ID NO: 5429 - protein, 15 aa, HIV-1
RLVITTYWGLHTGER

SEQ ID NO: 5430 - protein, 9 aa, HIV-1
VITTYWGLH

SEQ ID NO: 5431 - protein, 15 aa, HIV-1
RMRIRTWKSLVKHHM

SEQ ID NO: 5432 - protein, 9 aa, HIV-1
IRTWKSLVK

SEQ ID NO: 5433 - protein, 15 aa, HIV-1
RMRIRTWKSLVKHHM

SEQ ID NO: 5434 - protein, 9 aa, HIV-1
RTWKSLVKH

SEQ ID NO: 5435 - protein, 15 aa, HIV-1
RTWKSLVKHHMYVSG

SEQ ID NO: 5436 - protein, 9 aa, HIV-1
WKSLVKHHM

SEQ ID NO: 5437 - protein, 15 aa, HIV-1
RWQVMIVWQVDRMRI

SEQ ID NO: 5438 - protein, 9 aa, HIV-1
MIVWQVDRM

SEQ ID NO: 5439 - protein, 15 aa, HIV-1
RWQVMIVWQVDRMRI

SEQ ID NO: 5440 - protein, 9 aa, HIV-1
WQVMIVWQV

SEQ ID NO: 5441 - protein, 15 aa, HIV-1
SAIRKALLGHIVSPR

SEQ ID NO: 5442 - protein, 9 aa, HIV-1
AIRKALLGH

SEQ ID NO: 5443 - protein, 15 aa, HIV-1
SAIRKALLGHIVSPR

SEQ ID NO: 5444 - protein, 9 aa, HIV-1
RKALLGHIV

SEQ ID NO: 5445 - protein, 15 aa, HIV-1
SDSAIRKALLGHIVS

SEQ ID NO: 5446 - protein, 9 aa, HIV-1
AIRKALLGH

SEQ ID NO: 5447 - protein, 15 aa, HIV-1
SDSAIRKALLGHIVS

SEQ ID NO: 5448 - protein, 9 aa, HIV-1
IRKALLGHI

SEQ ID NO: 5449 - protein, 15 aa, HIV-1
SEVHIPLGDARLVIT

SEQ ID NO: 5450 - protein, 9 aa, HIV-1
IPLGDARLV

SEQ ID NO: 5451 - protein, 15 aa, HIV-1
SIEWRKKRYSTQVDP

SEQ ID NO: 5452 - protein, 9 aa, HIV-1
WRKKRYSTQ

SEQ ID NO: 5453 - protein, 15 aa, HIV-1
SLQYLALAALITPKK

SEQ ID NO: 5454 - protein, 9 aa, HIV-1
ALAALITPK

SEQ ID NO: 5455 - protein, 15 aa, HIV-1
SLQYLALAALITPKK

SEQ ID NO: 5456 - protein, 9 aa, HIV-1
LALAALITP

SEQ ID NO: 5457 - protein, 15 aa, HIV-1
SLQYLALAALITPKK

SEQ ID NO: 5458 - protein, 9 aa, HIV-1
YLALAALIT

SEQ ID NO: 5459 - protein, 15 aa, HIV-1
SLVKHHMYVSGKARG

SEQ ID NO: 5460 - protein, 9 aa, HIV-1
VKHHMYVSG

SEQ ID NO: 5461 - protein, 15 aa, HIV-1
SPRCEYQAGHNKVGS

SEQ ID NO: 5462 - protein, 9 aa, HIV-1
YQAGHNKVG

SEQ ID NO: 5463 - protein, 15 aa, HIV-1
SSEVHIPLGDARLVI

SEQ ID NO: 5464 - protein, 9 aa, HIV-1
IPLGDARLV

SEQ ID NO: 5465 - protein, 15 aa, HIV-1
TGERDWHLGQGVSIE

SEQ ID NO: 5466 - protein, 9 aa, HIV-1
WHLGQGVSI

SEQ ID NO: 5467 - protein, 15 aa, HIV-1
TPKKIKPPLPSVTKL

SEQ ID NO: 5468 - protein, 9 aa, HIV-1
IKPPLPSVT

SEQ ID NO: 5469 - protein, 15 aa, HIV-1
TWKSLVKHHMYVSGK

SEQ ID NO: 5470 - protein, 9 aa, HIV-1
VKHHMYVSG

SEQ ID NO: 5471 - protein, 15 aa, HIV-1
TWKSLVKHHMYVSGK

SEQ ID NO: 5472 - protein, 9 aa, HIV-1
WKSLVKHHM

SEQ ID NO: 5473 - protein, 15 aa, HIV-1
VDRMRIRTWKSLVKH

SEQ ID NO: 5474 - protein, 9 aa, HIV-1
IRTWKSLVK

SEQ ID NO: 5475 - protein, 15 aa, HIV-1
VGSLQYLALAALITP

SEQ ID NO: 5476 - protein, 9 aa, HIV-1
LQYLALAAL

SEQ ID NO: 5477 - protein, 15 aa, HIV-1
VGSLQYLALAALITP

SEQ ID NO: 5478 - protein, 9 aa, HIV-1
YLALAALIT

SEQ ID NO: 5479 - protein, 15 aa, HIV-1
VHIPLGDARLVITTY

SEQ ID NO: 5480 - protein, 9 aa, HIV-1
IPLGDARLV

SEQ ID NO: 5481 - protein, 15 aa, HIV-1
VITTYWGLHTGERDW

SEQ ID NO: 5482 - protein, 9 aa, HIV-1
VITTYWGLH

SEQ ID NO: 5483 - protein, 15 aa, HIV-1
VITTYWGLHTGERDW

SEQ ID NO: 5484 - protein, 9 aa, HIV-1
YWGLHTGER

SEQ ID NO: 5485 - protein, 15 aa, HIV-1
VKHHMYVSGKARGWF

SEQ ID NO: 5486 - protein, 9 aa, HIV-1
YVSGKARGW

SEQ ID NO: 5487 - protein, 15 aa, HIV-1
VMIVWQVDRMRIRTW

SEQ ID NO: 5488 - protein, 9 aa, HIV-1
IVWQVDRMR

SEQ ID NO: 5489 - protein, 15 aa, HIV-1
VMIVWQVDRMRIRTW

SEQ ID NO: 5490 - protein, 9 aa, HIV-1
MIVWQVDRM

SEQ ID NO: 5491 - protein, 15 aa, HIV-1
VMIVWQVDRMRIRTW

SEQ ID NO: 5492 - protein, 9 aa, HIV-1
WQVDRMRIR

SEQ ID NO: 5493 - protein, 15 aa, HIV-1
VSGKARGWFYRHHYE

SEQ ID NO: 5494 - protein, 9 aa, HIV-1
ARGWFYRHH

SEQ ID NO: 5495 - protein, 15 aa, HIV-1
VSIEWRKKRYSTQVD

SEQ ID NO: 5496 - protein, 9 aa, HIV-1
IEWRKKRYS

SEQ ID NO: 5497 - protein, 15 aa, HIV-1
VSIEWRKKRYSTQVD

SEQ ID NO: 5498 - protein, 9 aa, HIV-1
VSIEWRKKR

SEQ ID NO: 5499 - protein, 15 aa, HIV-1
VSIEWRKKRYSTQVD

SEQ ID NO: 5500 - protein, 9 aa, HIV-1
WRKKRYSTQ

SEQ ID NO: 5501 - protein, 15 aa, HIV-1
VSPRCEYQAGHNKVG

SEQ ID NO: 5502 - protein, 9 aa, HIV-1
EYQAGHNKV

SEQ ID NO: 5503 - protein, 15 aa, HIV-1
VWQVDRMRIRTWKSL

SEQ ID NO: 5504 - protein, 9 aa, HIV-1
RMRIRTWKS

SEQ ID NO: 5505 - protein, 15 aa, HIV-1
VWQVDRMRIRTWKSL

SEQ ID NO: 5506 - protein, 9 aa, HIV-1
VDRMRIRTW

SEQ ID NO: 5507 - protein, 15 aa, HIV-1
WFYRHHYESPHPRIS

SEQ ID NO: 5508 - protein, 9 aa, HIV-1
YRHHYESPH

SEQ ID NO: 5509 - protein, 15 aa, HIV-1
WHLGQGVSIEWRKKR

SEQ ID NO: 5510 - protein, 9 aa, HIV-1
GQGVSIEWR

SEQ ID NO: 5511 - protein, 15 aa, HIV-1
WHLGQGVSIEWRKKR

SEQ ID NO: 5512 - protein, 9 aa, HIV-1
LGQGVSIEW

SEQ ID NO: 5513 - protein, 15 aa, HIV-1
WKSLVKHHMYVSGKA

SEQ ID NO: 5514 - protein, 9 aa, HIV-1
VKHHMYVSG

SEQ ID NO: 5515 - protein, 15 aa, HIV-1
WKSLVKHHMYVSGKA

SEQ ID NO: 5516 - protein, 9 aa, HIV-1
WKSLVKHHM

SEQ ID NO: 5517 - protein, 15 aa, HIV-1
WQVDRMRIRTWKSLV

SEQ ID NO: 5518 - protein, 9 aa, HIV-1
MRIRTWKSL

SEQ ID NO: 5519 - protein, 15 aa, HIV-1
WQVDRMRIRTWKSLV

SEQ ID NO: 5520 - protein, 9 aa, HIV-1
RMRIRTWKS

SEQ ID NO: 5521 - protein, 15 aa, HIV-1
WQVMIVWQVDRMRIR

SEQ ID NO: 5522 - protein, 9 aa, HIV-1
MIVWQVDRM

SEQ ID NO: 5523 - protein, 15 aa, HIV-1
WQVMIVWQVDRMRIR

SEQ ID NO: 5524 - protein, 9 aa, HIV-1
VMIVWQVDR

SEQ ID NO: 5525 - protein, 15 aa, HIV-1
WQVMIVWQVDRMRIR

SEQ ID NO: 5526 - protein, 9 aa, HIV-1
WQVMIVWQV

SEQ ID NO: 5527 - protein, 15 aa, HIV-1
YLALAALITPKKIKP

SEQ ID NO: 5528 - protein, 9 aa, HIV-1
LAALITPKK

SEQ ID NO: 5529 - protein, 15 aa, HIV-1
YLALAALITPKKIKP

SEQ ID NO: 5530 - protein, 9 aa, HIV-1
YLALAALIT

SEQ ID NO: 5531 - protein, 15 aa, HIV-1
YQAGHNKVGSLQYLA

SEQ ID NO: 5532 - protein, 9 aa, HIV-1
YQAGHNKVG

SEQ ID NO: 5533 - protein, 15 aa, HIV-1
YRHHYESPHPRISSE

SEQ ID NO: 5534 - protein, 9 aa, HIV-1
YESPHPRIS

SEQ ID NO: 5535 - protein, 15 aa, HIV-1
YVSGKARGWFYRHHY

SEQ ID NO: 5536 - protein, 9 aa, HIV-1
ARGWFYRHH

SEQ ID NO: 5537 - protein, 15 aa, HIV-1
YVSGKARGWFYRHHY

SEQ ID NO: 5538 - protein, 9 aa, HIV-1
YVSGKARGW

SEQ ID NO: 5539 - protein, 8 aa, HIV-1
EPHNEWTL

SEQ ID NO: 5540 - protein, 8 aa, HIV-1
HNEWTLEL

SEQ ID NO: 5541 - protein, 8 aa, HIV-1
NEWTLELL

SEQ ID NO: 5542 - protein, 8 aa, HIV-1
TLELLEEL

SEQ ID NO: 5543 - protein, 8 aa, HIV-1
EELKNEAV

SEQ ID NO: 5544 - protein, 8 aa, HIV-1
ELKNEAVR

SEQ ID NO: 5545 - protein, 8 aa, HIV-1
EAVRHFPR

SEQ ID NO: 5546 - protein, 8 aa, HIV-1
AVRHFPRI

SEQ ID NO: 5547 - protein, 8 aa, HIV-1
GQHIYETY

SEQ ID NO: 5548 - protein, 8 aa, HIV-1
ETYGDTWA

SEQ ID NO: 5549 - protein, 8 aa, HIV-1
YGDTWAGV

SEQ ID NO: 5550 - protein, 8 aa, HIV-1
DTWAGVEA

SEQ ID NO: 5551 - protein, 8 aa, HIV-1
TWAGVEAI

SEQ ID NO: 5552 - protein, 8 aa, HIV-1
VEAIIRIL

SEQ ID NO: 5553 - protein, 8 aa, HIV-1
RILQQLLF

SEQ ID NO: 5554 - protein, 8 aa, HIV-1
ILQQLLFI

SEQ ID NO: 5555 - protein, 8 aa, HIV-1
QQLLFIHF

SEQ ID NO: 5556 - protein, 8 aa, HIV-1
QLLFIHFR

SEQ ID NO: 5557 - protein, 8 aa, HIV-1
LLFIHFRI

SEQ ID NO: 5558 - protein, 8 aa, HIV-1
RIGCRHSR

SEQ ID NO: 5559 - protein, 8 aa, HIV-1
HSRIGVTR

SEQ ID NO: 5560 - protein, 8 aa, HIV-1
RIGVTRQR

SEQ ID NO: 5561 - protein, 8 aa, HIV-1
VTRQRRAR

SEQ ID NO: 5562 - protein, 8 aa, HIV-1
RARNGASR

SEQ ID NO: 5563 - protein, 9 aa, HIV-1
REPHNEWTL

SEQ ID NO: 5564 - protein, 9 aa, HIV-1
PHNEWTLEL

SEQ ID NO: 5565 - protein, 9 aa, HIV-1
WTLELLEEL

SEQ ID NO: 5566 - protein, 9 aa, HIV-1
TLELLEELK

SEQ ID NO: 5567 - protein, 9 aa, HIV-1
LLEELKNEA

SEQ ID NO: 5568 - protein, 9 aa, HIV-1
NEAVRHFPR

SEQ ID NO: 5569 - protein, 9 aa, HIV-1
EAVRHFPRI

SEQ ID NO: 5570 - protein, 9 aa, HIV-1
FPRIWLHGL

SEQ ID NO: 5571 - protein, 9 aa, HIV-1
WLHGLGQHI

SEQ ID NO: 5572 - protein, 9 aa, HIV-1
GLGQHIYET

SEQ ID NO: 5573 - protein, 9 aa, HIV-1
IYETYGDTW

SEQ ID NO: 5574 - protein, 9 aa, HIV-1
YETYGDTWA

SEQ ID NO: 5575 - protein, 9 aa, HIV-1
ETYGDTWAG

SEQ ID NO: 5576 - protein, 9 aa, HIV-1
TYGDTWAGV

SEQ ID NO: 5577 - protein, 9 aa, HIV-1
DTWAGVEAI

SEQ ID NO: 5578 - protein, 9 aa, HIV-1
TWAGVEAII

SEQ ID NO: 5579 - protein, 9 aa, HIV-1
AIIRILQQL

SEQ ID NO: 5580 - protein, 9 aa, HIV-1
IRILQQLLF

SEQ ID NO: 5581 - protein, 9 aa, HIV-1
RILQQLLFI

SEQ ID NO: 5582 - protein, 9 aa, HIV-1
LQQLLFIHF

SEQ ID NO: 5583 - protein, 9 aa, HIV-1
QQLLFIHFR

SEQ ID NO: 5584 - protein, 9 aa, HIV-1
QLLFIHFRI

SEQ ID NO: 5585 - protein, 9 aa, HIV-1
FIHFRIGCR

SEQ ID NO: 5586 - protein, 9 aa, HIV-1
FRIGCRHSR

SEQ ID NO: 5587 - protein, 9 aa, HIV-1
RIGCRHSRI

SEQ ID NO: 5588 - protein, 9 aa, HIV-1
RHSRIGVTR

SEQ ID NO: 5589 - protein, 9 aa, HIV-1
SRIGVTRQR

SEQ ID NO: 5590 - protein, 9 aa, HIV-1
RIGVTRQRR

SEQ ID NO: 5591 - protein, 9 aa, HIV-1
GVTRQRRAR

SEQ ID NO: 5592 - protein, 9 aa, HIV-1
RQRRARNGA

SEQ ID NO: 5593 - protein, 9 aa, HIV-1
RRARNGASR

SEQ ID NO: 5594 - protein, 10 aa, HIV-1
QAPEDQGPQR

SEQ ID NO: 5595 - protein, 10 aa, HIV-1
EPHNEWTLEL

SEQ ID NO: 5596 - protein, 10 aa, HIV-1
WTLELLEELK

SEQ ID NO: 5597 - protein, 10 aa, HIV-1
ELLEELKNEA

SEQ ID NO: 5598 - protein, 10 aa, HIV-1
LLEELKNEAV

SEQ ID NO: 5599 - protein, 10 aa, HIV-1
ELKNEAVRHF

SEQ ID NO: 5600 - protein, 10 aa, HIV-1
KNEAVRHFPR

SEQ ID NO: 5601 - protein, 10 aa, HIV-1
EAVRHFPRIW

SEQ ID NO: 5602 - protein, 10 aa, HIV-1
AVRHFPRIWL

SEQ ID NO: 5603 - protein, 10 aa, HIV-1
HFPRIWLHGL

SEQ ID NO: 5604 - protein, 10 aa, HIV-1
FPRIWLHGLG

SEQ ID NO: 5605 - protein, 10 aa, HIV-1
IWLHGLGQHI

SEQ ID NO: 5606 - protein, 10 aa, HIV-1
WLHGLGQHIY

SEQ ID NO: 5607 - protein, 10 aa, HIV-1
GLGQHIYETY

SEQ ID NO: 5608 - protein, 10 aa, HIV-1
HIYETYGDTW

SEQ ID NO: 5609 - protein, 10 aa, HIV-1
ETYGDTWAGV

SEQ ID NO: 5610 - protein, 10 aa, HIV-1
DTWAGVEAII

SEQ ID NO: 5611 - protein, 10 aa, HIV-1
TWAGVEAIIR

SEQ ID NO: 5612 - protein, 10 aa, HIV-1
EAIIRILQQL

SEQ ID NO: 5613 - protein, 10 aa, HIV-1
AIIRILQQLL

SEQ ID NO: 5614 - protein, 10 aa, HIV-1
ILQQLLFIHF

SEQ ID NO: 5615 - protein, 10 aa, HIV-1
LQQLLFIHFR

SEQ ID NO: 5616 - protein, 10 aa, HIV-1
QQLLFIHFRI

SEQ ID NO: 5617 - protein, 10 aa, HIV-1
LLFIHFRIGC

SEQ ID NO: 5618 - protein, 10 aa, HIV-1
LFIHFRIGCR

SEQ ID NO: 5619 - protein, 10 aa, HIV-1
HFRIGCRHSR

SEQ ID NO: 5620 - protein, 10 aa, HIV-1
FRIGCRHSRI

SEQ ID NO: 5621 - protein, 10 aa, HIV-1
CRHSRIGVTR

SEQ ID NO: 5622 - protein, 10 aa, HIV-1
HSRIGVTRQR

SEQ ID NO: 5623 - protein, 10 aa, HIV-1
SRIGVTRQRR

SEQ ID NO: 5624 - protein, 10 aa, HIV-1
QRRARNGASR

SEQ ID NO: 5625 - protein, 11 aa, HIV-1
EQAPEDQGPQR

SEQ ID NO: 5626 - protein, 11 aa, HIV-1
REPHNEWTLEL

SEQ ID NO: 5627 - protein, 11 aa, HIV-1
EPHNEWTLELL

SEQ ID NO: 5628 - protein, 11 aa, HIV-1
NEWTLELLEEL

SEQ ID NO: 5629 - protein, 11 aa, HIV-1
ELLEELKNEAV

SEQ ID NO: 5630 - protein, 11 aa, HIV-1
EELKNEAVRHF

SEQ ID NO: 5631 - protein, 11 aa, HIV-1
EAVRHFPRIWL

SEQ ID NO: 5632 - protein, 11 aa, HIV-1
RHFPRIWLHGL

SEQ ID NO: 5633 - protein, 11 aa, HIV-1
RIWLHGLGQHI

SEQ ID NO: 5634 - protein, 11 aa, HIV-1
IWLHGLGQHIY

SEQ ID NO: 5635 - protein, 11 aa, HIV-1
WLHGLGQHIYE

SEQ ID NO: 5636 - protein, 11 aa, HIV-1
HIYETYGDTWA

SEQ ID NO: 5637 - protein, 11 aa, HIV-1
YETYGDTWAGV

SEQ ID NO: 5638 - protein, 11 aa, HIV-1
ETYGDTWAGVE

SEQ ID NO: 5639 - protein, 11 aa, HIV-1
DTWAGVEAIIR

SEQ ID NO: 5640 - protein, 11 aa, HIV-1
TWAGVEAIIRI

SEQ ID NO: 5641 - protein, 11 aa, HIV-1
VEAIIRILQQL

SEQ ID NO: 5642 - protein, 11 aa, HIV-1
EAIIRILQQLL

SEQ ID NO: 5643 - protein, 11 aa, HIV-1
AIIRILQQLLF

SEQ ID NO: 5644 - protein, 11 aa, HIV-1
IIRILQQLLFI

SEQ ID NO: 5645 - protein, 11 aa, HIV-1
RILQQLLFIHF

SEQ ID NO: 5646 - protein, 11 aa, HIV-1
ILQQLLFIHFR

SEQ ID NO: 5647 - protein, 11 aa, HIV-1
LQQLLFIHFRI

SEQ ID NO: 5648 - protein, 11 aa, HIV-1
QLLFIHFRIGC

SEQ ID NO: 5649 - protein, 11 aa, HIV-1
LLFIHFRIGCR

SEQ ID NO: 5650 - protein, 11 aa, HIV-1
IHFRIGCRHSR

SEQ ID NO: 5651 - protein, 11 aa, HIV-1
RIGCRHSRIGV

SEQ ID NO: 5652 - protein, 11 aa, HIV-1
GCRHSRIGVTR

SEQ ID NO: 5653 - protein, 11 aa, HIV-1
HSRIGVTRQRR

SEQ ID NO: 5654 - protein, 11 aa, HIV-1
RIGVTRQRRAR

SEQ ID NO: 5655 - protein, 11 aa, HIV-1
RQRRARNGASR

SEQ ID NO: 5656 - protein, 15 aa, HIV-1
AGVEAIIRILQQLLF

SEQ ID NO: 5657 - protein, 9 aa, HIV-1
VEAIIRILQ

SEQ ID NO: 5658 - protein, 15 aa, HIV-1
AIIRILQQLLFIHFR

SEQ ID NO: 5659 - protein, 9 aa, HIV-1
ILQQLLFIH

SEQ ID NO: 5660 - protein, 15 aa, HIV-1
AIIRILQQLLFIHFR

SEQ ID NO: 5661 - protein, 9 aa, HIV-1
IRILQQLLF

SEQ ID NO: 5662 - protein, 15 aa, HIV-1
AIIRILQQLLFIHFR

SEQ ID NO: 5663 - protein, 9 aa, HIV-1
LQQLLFIHF

SEQ ID NO: 5664 - protein, 15 aa, HIV-1
DTWAGVEAIIRILQQ

SEQ ID NO: 5665 - protein, 9 aa, HIV-1
WAGVEAIIR

SEQ ID NO: 5666 - protein, 15 aa, HIV-1
EAIIRILQQLLFIHF

SEQ ID NO: 5667 - protein, 9 aa, HIV-1
IIRILQQLL

SEQ ID NO: 5668 - protein, 15 aa, HIV-1
EAIIRILQQLLFIHF

SEQ ID NO: 5669 - protein, 9 aa, HIV-1
ILQQLLFIH

SEQ ID NO: 5670 - protein, 15 aa, HIV-1
EAIIRILQQLLFIHF

SEQ ID NO: 5671 - protein, 9 aa, HIV-1
IRILQQLLF

SEQ ID NO: 5672 - protein, 15 aa, HIV-1
EAVRHFPRIWLHGLG

SEQ ID NO: 5673 - protein, 9 aa, HIV-1
VRHFPRIWL

SEQ ID NO: 5674 - protein, 15 aa, HIV-1
EELKNEAVRHFPRIW

SEQ ID NO: 5675 - protein, 9 aa, HIV-1
LKNEAVRHF

SEQ ID NO: 5676 - protein, 15 aa, HIV-1
ELKNEAVRHFPRIWL

SEQ ID NO: 5677 - protein, 9 aa, HIV-1
LKNEAVRHF

SEQ ID NO: 5678 - protein, 15 aa, HIV-1
ELKNEAVRHFPRIWL

SEQ ID NO: 5679 - protein, 9 aa, HIV-1
NEAVRHFPR

SEQ ID NO: 5680 - protein, 15 aa, HIV-1
ELLEELKNEAVRHFP

SEQ ID NO: 5681 - protein, 9 aa, HIV-1
LKNEAVRHF

SEQ ID NO: 5682 - protein, 15 aa, HIV-1
ETYGDTWAGVEAIIR

SEQ ID NO: 5683 - protein, 9 aa, HIV-1
DTWAGVEAI

SEQ ID NO: 5684 - protein, 15 aa, HIV-1
FIHFRIGCRHSRIGV

SEQ ID NO: 5685 - protein, 9 aa, HIV-1
FIHFRIGCR

SEQ ID NO: 5686 - protein, 15 aa, HIV-1
FPRIWLHGLGQHIYE

SEQ ID NO: 5687 - protein, 9 aa, HIV-1
IWLHGLGQH

SEQ ID NO: 5688 - protein, 15 aa, HIV-1
FPRIWLHGLGQHIYE

SEQ ID NO: 5689 - protein, 9 aa, HIV-1
WLHGLGQHI

SEQ ID NO: 5690 - protein, 15 aa, HIV-1
GDTWAGVEAIIRILQ

SEQ ID NO: 5691 - protein, 9 aa, HIV-1
WAGVEAIIR

SEQ ID NO: 5692 - protein, 15 aa, HIV-1
GVEAIIRILQQLLFI

SEQ ID NO: 5693 - protein, 9 aa, HIV-1
IRILQQLLF

SEQ ID NO: 5694 - protein, 15 aa, HIV-1
HFPRIWLHGLGQHIY

SEQ ID NO: 5695 - protein, 9 aa, HIV-1
IWLHGLGQH

SEQ ID NO: 5696 - protein, 15 aa, HIV-1
HFPRIWLHGLGQHIY

SEQ ID NO: 5697 - protein, 9 aa, HIV-1
WLHGLGQHI

SEQ ID NO: 5698 - protein, 15 aa, HIV-1
IIRILQQLLFIHFRI

SEQ ID NO: 5699 - protein, 9 aa, HIV-1
ILQQLLFIH

SEQ ID NO: 5700 - protein, 15 aa, HIV-1
IIRILQQLLFIHFRI

SEQ ID NO: 5701 - protein, 9 aa, HIV-1
IRILQQLLF

SEQ ID NO: 5702 - protein, 15 aa, HIV-1
IIRILQQLLFIHFRI

SEQ ID NO: 5703 - protein, 9 aa, HIV-1
LQQLLFIHF

SEQ ID NO: 5704 - protein, 15 aa, HIV-1
ILQQLLFIHFRIGCR

SEQ ID NO: 5705 - protein, 9 aa, HIV-1
ILQQLLFIH

SEQ ID NO: 5706 - protein, 15 aa, HIV-1
ILQQLLFIHFRIGCR

SEQ ID NO: 5707 - protein, 9 aa, HIV-1
LLFIHFRIG

SEQ ID NO: 5708 - protein, 15 aa, HIV-1
IRILQQLLFIHFRIG

SEQ ID NO: 5709 - protein, 9 aa, HIV-1
ILQQLLFIH

SEQ ID NO: 5710 - protein, 15 aa, HIV-1
IRILQQLLFIHFRIG

SEQ ID NO: 5711 - protein, 9 aa, HIV-1
IRILQQLLF

SEQ ID NO: 5712 - protein, 15 aa, HIV-1
KNEAVRHFPRIWLHG

SEQ ID NO: 5713 - protein, 9 aa, HIV-1
VRHFPRIWL

SEQ ID NO: 5714 - protein, 15 aa, HIV-1
LEELKNEAVRHFPRI

SEQ ID NO: 5715 - protein, 9 aa, HIV-1
LKNEAVRHF

SEQ ID NO: 5716 - protein, 15 aa, HIV-1
LELLEELKNEAVRHF

SEQ ID NO: 5717 - protein, 9 aa, HIV-1
ELKNEAVRH

SEQ ID NO: 5718 - protein, 15 aa, HIV-1
LELLEELKNEAVRHF

SEQ ID NO: 5719 - protein, 9 aa, HIV-1
LEELKNEAV

SEQ ID NO: 5720 - protein, 15 aa, HIV-1
LFIHFRIGCRHSRIG

SEQ ID NO: 5721 - protein, 9 aa, HIV-1
FIHFRIGCR

SEQ ID NO: 5722 - protein, 15 aa, HIV-1
LKNEAVRHFPRIWLH

SEQ ID NO: 5723 - protein, 9 aa, HIV-1
LKNEAVRHF

SEQ ID NO: 5724 - protein, 15 aa, HIV-1
LKNEAVRHFPRIWLH

SEQ ID NO: 5725 - protein, 9 aa, HIV-1
VRHFPRIWL

SEQ ID NO: 5726 - protein, 15 aa, HIV-1
LLEELKNEAVRHFPR

SEQ ID NO: 5727 - protein, 9 aa, HIV-1
LKNEAVRHF

SEQ ID NO: 5728 - protein, 15 aa, HIV-1
LLFIHFRIGCRHSRI

SEQ ID NO: 5729 - protein, 9 aa, HIV-1
FIHFRIGCR

SEQ ID NO: 5730 - protein, 15 aa, HIV-1
LQQLLFIHFRIGCRH

SEQ ID NO: 5731 - protein, 9 aa, HIV-1
FIHFRIGCR

SEQ ID NO: 5732 - protein, 15 aa, HIV-1
NEAVRHFPRIWLHGL

SEQ ID NO: 5733 - protein, 9 aa, HIV-1
VRHFPRIWL

SEQ ID NO: 5734 - protein, 15 aa, HIV-1
PRIWLHGLGQHIYET

SEQ ID NO: 5735 - protein, 9 aa, HIV-1
WLHGLGQHI

SEQ ID NO: 5736 - protein, 15 aa, HIV-1
QLLFIHFRIGCRHSR

SEQ ID NO: 5737 - protein, 9 aa, HIV-1
FIHFRIGCR

SEQ ID NO: 5738 - protein, 15 aa, HIV-1
QQLLFIHFRIGCRHS

SEQ ID NO: 5739 - protein, 9 aa, HIV-1
FIHFRIGCR

SEQ ID NO: 5740 - protein, 15 aa, HIV-1
RHFPRIWLHGLGQHI

SEQ ID NO: 5741 - protein, 9 aa, HIV-1
FPRIWLHGL

SEQ ID NO: 5742 - protein, 15 aa, HIV-1
RHFPRIWLHGLGQHI

SEQ ID NO: 5743 - protein, 9 aa, HIV-1
IWLHGLGQH

SEQ ID NO: 5744 - protein, 15 aa, HIV-1
RILQQLLFIHFRIGC

SEQ ID NO: 5745 - protein, 9 aa, HIV-1
ILQQLLFIH

SEQ ID NO: 5746 - protein, 15 aa, HIV-1
RIWLHGLGQHIYETY

SEQ ID NO: 5747 - protein, 9 aa, HIV-1
WLHGLGQHI

SEQ ID NO: 5748 - protein, 15 aa, HIV-1
TYGDTWAGVEAIIRI

SEQ ID NO: 5749 - protein, 9 aa, HIV-1
WAGVEAIIR

SEQ ID NO: 5750 - protein, 15 aa, HIV-1
VEAIIRILQQLLFIH

SEQ ID NO: 5751 - protein, 9 aa, HIV-1
IRILQQLLF

SEQ ID NO: 5752 - protein, 15 aa, HIV-1
VRHFPRIWLHGLGQH

SEQ ID NO: 5753 - protein, 9 aa, HIV-1
FPRIWLHGL

SEQ ID NO: 5754 - protein, 15 aa, HIV-1
WAGVEAIIRILQQLL

SEQ ID NO: 5755 - protein, 9 aa, HIV-1
WAGVEAIIR

SEQ ID NO: 5756 - protein, 15 aa, HIV-1
YGDTWAGVEAIIRIL

SEQ ID NO: 5757 - protein, 9 aa, HIV-1
WAGVEAIIR

SEQ ID NO: 5758 - protein, 8 aa, HIV-1
MQPIPIVA

SEQ ID NO: 5759 - protein, 8 aa, HIV-1
QPIPIVAI

SEQ ID NO: 5760 - protein, 8 aa, HIV-1
PIPIVAIV

SEQ ID NO: 5761 - protein, 8 aa, HIV-1
IPIVAIVA

SEQ ID NO: 5762 - protein, 8 aa, HIV-1
PIVAIVAL

SEQ ID NO: 5763 - protein, 8 aa, HIV-1
IVAIVALV

SEQ ID NO: 5764 - protein, 8 aa, HIV-1
VAIVALVV

SEQ ID NO: 5765 - protein, 8 aa, HIV-1
AIVALVVA

SEQ ID NO: 5766 - protein, 8 aa, HIV-1
IVALVVAI

SEQ ID NO: 5767 - protein, 8 aa, HIV-1
ALVVAIII

SEQ ID NO: 5768 - protein, 8 aa, HIV-1
LVVAIIIA

SEQ ID NO: 5769 - protein, 8 aa, HIV-1
VVAIIIAI

SEQ ID NO: 5770 - protein, 8 aa, HIV-1
VAIIIAIV

SEQ ID NO: 5771 - protein, 8 aa, HIV-1
AIIIAIVV

SEQ ID NO: 5772 - protein, 8 aa, HIV-1
IIIAIVVW

SEQ ID NO: 5773 - protein, 8 aa, HIV-1
IAIVVWSI

SEQ ID NO: 5774 - protein, 8 aa, HIV-1
AIVVWSIV

SEQ ID NO: 5775 - protein, 8 aa, HIV-1
IVVWSIVI

SEQ ID NO: 5776 - protein, 8 aa, HIV-1
VVWSIVII

SEQ ID NO: 5777 - protein, 8 aa, HIV-1
WSIVIIEY

SEQ ID NO: 5778 - protein, 8 aa, HIV-1
SIVIIEYR

SEQ ID NO: 5779 - protein, 8 aa, HIV-1
IVIIEYRK

SEQ ID NO: 5780 - protein, 8 aa, HIV-1
VIIEYRKI

SEQ ID NO: 5781 - protein, 8 aa, HIV-1
IEYRKILR

SEQ ID NO: 5782 - protein, 8 aa, HIV-1
RKILRQRK

SEQ ID NO: 5783 - protein, 8 aa, HIV-1
SEGEISAL

SEQ ID NO: 5784 - protein, 8 aa, HIV-1
EISALVEM

SEQ ID NO: 5785 - protein, 8 aa, HIV-1
SALVEMGV

SEQ ID NO: 5786 - protein, 8 aa, HIV-1
LVEMGVEM

SEQ ID NO: 5787 - protein, 8 aa, HIV-1
APWDVDDL

SEQ ID NO: 5788 - protein, 9 aa, HIV-1
MQPIPIVAI

SEQ ID NO: 5789 - protein, 9 aa, HIV-1
QPIPIVAIV

SEQ ID NO: 5790 - protein, 9 aa, HIV-1
IPIVAIVAL

SEQ ID NO: 5791 - protein, 9 aa, HIV-1
PIVAIVALV

SEQ ID NO: 5792 - protein, 9 aa, HIV-1
IVAIVALVV

SEQ ID NO: 5793 - protein, 9 aa, HIV-1
AIVALVVAI

SEQ ID NO: 5794 - protein, 9 aa, HIV-1
IVALVVAII

SEQ ID NO: 5795 - protein, 9 aa, HIV-1
VALVVAIII

SEQ ID NO: 5796 - protein, 9 aa, HIV-1
ALVVAIIIA

SEQ ID NO: 5797 - protein, 9 aa, HIV-1
LVVAIIIAI

SEQ ID NO: 5798 - protein, 9 aa, HIV-1
VVAIIIAIV

SEQ ID NO: 5799 - protein, 9 aa, HIV-1
VAIIIAIVV

SEQ ID NO: 5800 - protein, 9 aa, HIV-1
AIIIAIVVW

SEQ ID NO: 5801 - protein, 9 aa, HIV-1
IIAIVVWSI

SEQ ID NO: 5802 - protein, 9 aa, HIV-1
IAIVVWSIV

SEQ ID NO: 5803 - protein, 9 aa, HIV-1
AIVVWSIVI

SEQ ID NO: 5804 - protein, 9 aa, HIV-1
IVVWSIVII

SEQ ID NO: 5805 - protein, 9 aa, HIV-1
VWSIVIIEY

SEQ ID NO: 5806 - protein, 9 aa, HIV-1
WSIVIIEYR

SEQ ID NO: 5807 - protein, 9 aa, HIV-1
SIVIIEYRK

SEQ ID NO: 5808 - protein, 9 aa, HIV-1
VIIEYRKIL

SEQ ID NO: 5809 - protein, 9 aa, HIV-1
IIEYRKILR

SEQ ID NO: 5810 - protein, 9 aa, HIV-1
EYRKILRQR

SEQ ID NO: 5811 - protein, 9 aa, HIV-1
YRKILRQRK

SEQ ID NO: 5812 - protein, 9 aa, HIV-1
ILRQRKIDR

SEQ ID NO: 5813 - protein, 9 aa, HIV-1
KIDRLIDRL

SEQ ID NO: 5814 - protein, 9 aa, HIV-1
RLIDRLIER

SEQ ID NO: 5815 - protein, 9 aa, HIV-1
LIDRLIERA

SEQ ID NO: 5816 - protein, 9 aa, HIV-1
ESEGEISAL

SEQ ID NO: 5817 - protein, 9 aa, HIV-1
SEGEISALV

SEQ ID NO: 5818 - protein, 9 aa, HIV-1
GEISALVEM

SEQ ID NO: 5819 - protein, 9 aa, HIV-1
ISALVEMGV

SEQ ID NO: 5820 - protein, 9 aa, HIV-1
ALVEMGVEM

SEQ ID NO: 5821 - protein, 9 aa, HIV-1
VEMGHHAPW

SEQ ID NO: 5822 - protein, 10 aa, HIV-1
MQPIPIVAIV

SEQ ID NO: 5823 - protein, 10 aa, HIV-1
QPIPIVAIVA

SEQ ID NO: 5824 - protein, 10 aa, HIV-1
IPIVAIVALV

SEQ ID NO: 5825 - protein, 10 aa, HIV-1
PIVAIVALVV

SEQ ID NO: 5826 - protein, 10 aa, HIV-1
VAIVALVVAI

SEQ ID NO: 5827 - protein, 10 aa, HIV-1
AIVALVVAII

SEQ ID NO: 5828 - protein, 10 aa, HIV-1
IVALVVAIII

SEQ ID NO: 5829 - protein, 10 aa, HIV-1
ALVVAIIIAI

SEQ ID NO: 5830 - protein, 10 aa, HIV-1
LVVAIIIAIV

SEQ ID NO: 5831 - protein, 10 aa, HIV-1
VVAIIIAIVV

SEQ ID NO: 5832 - protein, 10 aa, HIV-1
VAIIIAIVVW

SEQ ID NO: 5833 - protein, 10 aa, HIV-1
IIIAIVVWSI

SEQ ID NO: 5834 - protein, 10 aa, HIV-1
IIAIVVWSIV

SEQ ID NO: 5835 - protein, 10 aa, HIV-1
IAIVVWSIVI

SEQ ID NO: 5836 - protein, 10 aa, HIV-1
AIVVWSIVII

SEQ ID NO: 5837 - protein, 10 aa, HIV-1
VVWSIVIIEY

SEQ ID NO: 5838 - protein, 10 aa, HIV-1
VWSIVIIEYR

SEQ ID NO: 5839 - protein, 10 aa, HIV-1
WSIVIIEYRK

SEQ ID NO: 5840 - protein, 10 aa, HIV-1
VIIEYRKILR

SEQ ID NO: 5841 - protein, 10 aa, HIV-1
IEYRKILRQR

SEQ ID NO: 5842 - protein, 10 aa, HIV-1
EYRKILRQRK

SEQ ID NO: 5843 - protein, 10 aa, HIV-1
KILRQRKIDR

SEQ ID NO: 5844 - protein, 10 aa, HIV-1
ILRQRKIDRL

SEQ ID NO: 5845 - protein, 10 aa, HIV-1
KIDRLIDRLI

SEQ ID NO: 5846 - protein, 10 aa, HIV-1
RLIDRLIERA

SEQ ID NO: 5847 - protein, 10 aa, HIV-1
NESEGEISAL

SEQ ID NO: 5848 - protein, 10 aa, HIV-1
ESEGEISALV

SEQ ID NO: 5849 - protein, 10 aa, HIV-1
EISALVEMGV

SEQ ID NO: 5850 - protein, 10 aa, HIV-1
SALVEMGVEM

SEQ ID NO: 5851 - protein, 10 aa, HIV-1
EMGHHAPWDV

SEQ ID NO: 5852 - protein, 10 aa, HIV-1
HHAPWDVDDL

SEQ ID NO: 5853 - protein, 11 aa, HIV-1
MQPIPIVAIVA

SEQ ID NO: 5854 - protein, 11 aa, HIV-1
QPIPIVAIVAL

SEQ ID NO: 5855 - protein, 11 aa, HIV-1
PIPIVAIVALV

SEQ ID NO: 5856 - protein, 11 aa, HIV-1
IPIVAIVALVV

SEQ ID NO: 5857 - protein, 11 aa, HIV-1
IVAIVALVVAI

SEQ ID NO: 5858 - protein, 11 aa, HIV-1
VAIVALVVAII

SEQ ID NO: 5859 - protein, 11 aa, HIV-1
AIVALVVAIII

SEQ ID NO: 5860 - protein, 11 aa, HIV-1
IVALVVAIIIA

SEQ ID NO: 5861 - protein, 11 aa, HIV-1
ALVVAIIIAIV

SEQ ID NO: 5862 - protein, 11 aa, HIV-1
LVVAIIIAIVV

SEQ ID NO: 5863 - protein, 11 aa, HIV-1
VVAIIIAIVVW

SEQ ID NO: 5864 - protein, 11 aa, HIV-1
AIIIAIVVWSI

SEQ ID NO: 5865 - protein, 11 aa, HIV-1
IIIAIVVWSIV

SEQ ID NO: 5866 - protein, 11 aa, HIV-1
IIAIVVWSIVI

SEQ ID NO: 5867 - protein, 11 aa, HIV-1
IAIVVWSIVII

SEQ ID NO: 5868 - protein, 11 aa, HIV-1
IVVWSIVIIEY

SEQ ID NO: 5869 - protein, 11 aa, HIV-1
VVWSIVIIEYR

SEQ ID NO: 5870 - protein, 11 aa, HIV-1
VWSIVIIEYRK

SEQ ID NO: 5871 - protein, 11 aa, HIV-1
WSIVIIEYRKI

SEQ ID NO: 5872 - protein, 11 aa, HIV-1
SIVIIEYRKIL

SEQ ID NO: 5873 - protein, 11 aa, HIV-1
IVIIEYRKILR

SEQ ID NO: 5874 - protein, 11 aa, HIV-1
IIEYRKILRQR

SEQ ID NO: 5875 - protein, 11 aa, HIV-1
EYRKILRQRKI

SEQ ID NO: 5876 - protein, 11 aa, HIV-1
KILRQRKIDRL

SEQ ID NO: 5877 - protein, 11 aa, HIV-1
ILRQRKIDRLI

SEQ ID NO: 5878 - protein, 11 aa, HIV-1
RQRKIDRLIDR

SEQ ID NO: 5879 - protein, 11 aa, HIV-1
NESEGEISALV

SEQ ID NO: 5880 - protein, 11 aa, HIV-1
SEGEISALVEM

SEQ ID NO: 5881 - protein, 11 aa, HIV-1
GEISALVEMGV

SEQ ID NO: 5882 - protein, 11 aa, HIV-1
ISALVEMGVEM

SEQ ID NO: 5883 - protein, 11 aa, HIV-1
MGVEMGHHAPW

SEQ ID NO: 5884 - protein, 11 aa, HIV-1
VEMGHHAPWDV

SEQ ID NO: 5885 - protein, 15 aa, HIV-1
AIIIAIVVWSIVIIE

SEQ ID NO: 5886 - protein, 9 aa, HIV-1
IIAIVVWSI

SEQ ID NO: 5887 - protein, 15 aa, HIV-1
AIIIAIVVWSIVIIE

SEQ ID NO: 5888 - protein, 9 aa, HIV-1
IVVWSIVII

SEQ ID NO: 5889 - protein, 15 aa, HIV-1
AIVALVVAIIIAIVV

SEQ ID NO: 5890 - protein, 9 aa, HIV-1
IVALVVAII

SEQ ID NO: 5891 - protein, 15 aa, HIV-1
AIVALVVAIIIAIVV

SEQ ID NO: 5892 - protein, 9 aa, HIV-1
LVVAIIIAI

SEQ ID NO: 5893 - protein, 15 aa, HIV-1
AIVVWSIVIIEYRKI

SEQ ID NO: 5894 - protein, 9 aa, HIV-1
IVVWSIVII

SEQ ID NO: 5895 - protein, 15 aa, HIV-1
AIVVWSIVIIEYRKI

SEQ ID NO: 5896 - protein, 9 aa, HIV-1
VVWSIVIIE

SEQ ID NO: 5897 - protein, 15 aa, HIV-1
AIVVWSIVIIEYRKI

SEQ ID NO: 5898 - protein, 9 aa, HIV-1
WSIVIIEYR

SEQ ID NO: 5899 - protein, 15 aa, HIV-1
ALVEMGVEMGHHAPW

SEQ ID NO: 5900 - protein, 9 aa, HIV-1
LVEMGVEMG

SEQ ID NO: 5901 - protein, 15 aa, HIV-1
ALVVAIIIAIVVWSI

SEQ ID NO: 5902 - protein, 9 aa, HIV-1
IIIAIVVWS

SEQ ID NO: 5903 - protein, 15 aa, HIV-1
ALVVAIIIAIVVWSI

SEQ ID NO: 5904 - protein, 9 aa, HIV-1
VAIIIAIVV

SEQ ID NO: 5905 - protein, 15 aa, HIV-1
ALVVAIIIAIVVWSI

SEQ ID NO: 5906 - protein, 9 aa, HIV-1
VVAIIIAIV

SEQ ID NO: 5907 - protein, 15 aa, HIV-1
EGEISALVEMGVEMG

SEQ ID NO: 5908 - protein, 9 aa, HIV-1
ISALVEMGV

SEQ ID NO: 5909 - protein, 15 aa, HIV-1
EISALVEMGVEMGHH

SEQ ID NO: 5910 - protein, 9 aa, HIV-1
LVEMGVEMG

SEQ ID NO: 5911 - protein, 15 aa, HIV-1
EMGVEMGHHAPWDVD

SEQ ID NO: 5912 - protein, 9 aa, HIV-1
MGHHAPWDV

SEQ ID NO: 5913 - protein, 15 aa, HIV-1
EYRKILRQRKIDRLI

SEQ ID NO: 5914 - protein, 9 aa, HIV-1
ILRQRKIDR

SEQ ID NO: 5915 - protein, 15 aa, HIV-1
EYRKILRQRKIDRLI

SEQ ID NO: 5916 - protein, 9 aa, HIV-1
LRQRKIDRL

SEQ ID NO: 5917 - protein, 15 aa, HIV-1
EYRKILRQRKIDRLI

SEQ ID NO: 5918 - protein, 9 aa, HIV-1
YRKILRQRK

SEQ ID NO: 5919 - protein, 15 aa, HIV-1
GEISALVEMGVEMGH

SEQ ID NO: 5920 - protein, 9 aa, HIV-1
LVEMGVEMG

SEQ ID NO: 5921 - protein, 15 aa, HIV-1
GVEMGHHAPWDVDDL

SEQ ID NO: 5922 - protein, 9 aa, HIV-1
MGHHAPWDV

SEQ ID NO: 5923 - protein, 15 aa, HIV-1
IAIVVWSIVIIEYRK

SEQ ID NO: 5924 - protein, 9 aa, HIV-1
IVVWSIVII

SEQ ID NO: 5925 - protein, 15 aa, HIV-1
IEYRKILRQRKIDRL

SEQ ID NO: 5926 - protein, 9 aa, HIV-1
ILRQRKIDR

SEQ ID NO: 5927 - protein, 15 aa, HIV-1
IEYRKILRQRKIDRL

SEQ ID NO: 5928 - protein, 9 aa, HIV-1
YRKILRQRK

SEQ ID NO: 5929 - protein, 15 aa, HIV-1
IIAIVVWSIVIIEYR

SEQ ID NO: 5930 - protein, 9 aa, HIV-1
IIAIVVWSI

SEQ ID NO: 5931 - protein, 15 aa, HIV-1
IIAIVVWSIVIIEYR

SEQ ID NO: 5932 - protein, 9 aa, HIV-1
IVVWSIVII

SEQ ID NO: 5933 - protein, 15 aa, HIV-1
IIEYRKILRQRKIDR

SEQ ID NO: 5934 - protein, 9 aa, HIV-1
EYRKILRQR

SEQ ID NO: 5935 - protein, 15 aa, HIV-1
IIEYRKILRQRKIDR

SEQ ID NO: 5936 - protein, 9 aa, HIV-1
YRKILRQRK

SEQ ID NO: 5937 - protein, 15 aa, HIV-1
IIIAIVVWSIVIIEY

SEQ ID NO: 5938 - protein, 9 aa, HIV-1
IIAIVVWSI

SEQ ID NO: 5939 - protein, 15 aa, HIV-1
IIIAIVVWSIVIIEY

SEQ ID NO: 5940 - protein, 9 aa, HIV-1
IVVWSIVII

SEQ ID NO: 5941 - protein, 15 aa, HIV-1
ILRQRKIDRLIDRLI

SEQ ID NO: 5942 - protein, 9 aa, HIV-1
ILRQRKIDR

SEQ ID NO: 5943 - protein, 15 aa, HIV-1
IPIVAIVALVVAIII

SEQ ID NO: 5944 - protein, 9 aa, HIV-1
IVAIVALVV

SEQ ID NO: 5945 - protein, 15 aa, HIV-1
IPIVAIVALVVAIII

SEQ ID NO: 5946 - protein, 9 aa, HIV-1
VAIVALVVA

SEQ ID NO: 5947 - protein, 15 aa, HIV-1
ISALVEMGVEMGHHA

SEQ ID NO: 5948 - protein, 9 aa, HIV-1
LVEMGVEMG

SEQ ID NO: 5949 - protein, 15 aa, HIV-1
IVAIVALVVAIIIAI

SEQ ID NO: 5950 - protein, 9 aa, HIV-1
IVAIVALVV

SEQ ID NO: 5951 - protein, 15 aa, HIV-1
IVAIVALVVAIIIAI

SEQ ID NO: 5952 - protein, 9 aa, HIV-1
IVALVVAII

SEQ ID NO: 5953 - protein, 15 aa, HIV-1
IVAIVALVVAIIIAI

SEQ ID NO: 5954 - protein, 9 aa, HIV-1
VAIVALVVA

SEQ ID NO: 5955 - protein, 15 aa, HIV-1
IVALVVAIIIAIVVW

SEQ ID NO: 5956 - protein, 9 aa, HIV-1
LVVAIIIAI

SEQ ID NO: 5957 - protein, 15 aa, HIV-1
IVALVVAIIIAIVVW

SEQ ID NO: 5958 - protein, 9 aa, HIV-1
VAIIIAIVV

SEQ ID NO: 5959 - protein, 15 aa, HIV-1
IVIIEYRKILRQRKI

SEQ ID NO: 5960 - protein, 9 aa, HIV-1
IIEYRKILR

SEQ ID NO: 5961 - protein, 15 aa, HIV-1
IVIIEYRKILRQRKI

SEQ ID NO: 5962 - protein, 9 aa, HIV-1
YRKILRQRK

SEQ ID NO: 5963 - protein, 15 aa, HIV-1
IVVWSIVIIEYRKIL

SEQ ID NO: 5964 - protein, 9 aa, HIV-1
IVVWSIVII

SEQ ID NO: 5965 - protein, 15 aa, HIV-1
KILRQRKIDRLIDRL

SEQ ID NO: 5966 - protein, 9 aa, HIV-1
ILRQRKIDR

SEQ ID NO: 5967 - protein, 15 aa, HIV-1
KILRQRKIDRLIDRL

SEQ ID NO: 5968 - protein, 9 aa, HIV-1
LRQRKIDRL

SEQ ID NO: 5969 - protein, 15 aa, HIV-1
LVVAIIIAIVVWSIV

SEQ ID NO: 5970 - protein, 9 aa, HIV-1
IIAIVVWSI

SEQ ID NO: 5971 - protein, 15 aa, HIV-1
LVVAIIIAIVVWSIV

SEQ ID NO: 5972 - protein, 9 aa, HIV-1
IIIAIVVWS

SEQ ID NO: 5973 - protein, 15 aa, HIV-1
LVVAIIIAIVVWSIV

SEQ ID NO: 5974 - protein, 9 aa, HIV-1
VAIIIAIVV

SEQ ID NO: 5975 - protein, 15 aa, HIV-1
MGVEMGHHAPWDVDD

SEQ ID NO: 5976 - protein, 9 aa, HIV-1
MGHHAPWDV

SEQ ID NO: 5977 - protein, 15 aa, HIV-1
MQPIPIVAIVALVVA

SEQ ID NO: 5978 - protein, 9 aa, HIV-1
IPIVAIVAL

SEQ ID NO: 5979 - protein, 15 aa, HIV-1
MQPIPIVAIVALVVA

SEQ ID NO: 5980 - protein, 9 aa, HIV-1
IVAIVALVV

SEQ ID NO: 5981 - protein, 15 aa, HIV-1
PIPIVAIVALVVAII

SEQ ID NO: 5982 - protein, 9 aa, HIV-1
IVAIVALVV

SEQ ID NO: 5983 - protein, 15 aa, HIV-1
PIPIVAIVALVVAII

SEQ ID NO: 5984 - protein, 9 aa, HIV-1
VAIVALVVA

SEQ ID NO: 5985 - protein, 15 aa, HIV-1
PIVAIVALVVAIIIA

SEQ ID NO: 5986 - protein, 9 aa, HIV-1
IVAIVALVV

SEQ ID NO: 5987 - protein, 15 aa, HIV-1
PIVAIVALVVAIIIA

SEQ ID NO: 5988 - protein, 9 aa, HIV-1
VAIVALVVA

SEQ ID NO: 5989 - protein, 15 aa, HIV-1
QPIPIVAIVALVVAI

SEQ ID NO: 5990 - protein, 9 aa, HIV-1
IVAIVALVV

SEQ ID NO: 5991 - protein, 15 aa, HIV-1
QPIPIVAIVALVVAI

SEQ ID NO: 5992 - protein, 9 aa, HIV-1
VAIVALVVA

SEQ ID NO: 5993 - protein, 15 aa, HIV-1
RKILRQRKIDRLIDR

SEQ ID NO: 5994 - protein, 9 aa, HIV-1
ILRQRKIDR

SEQ ID NO: 5995 - protein, 15 aa, HIV-1
RKILRQRKIDRLIDR

SEQ ID NO: 5996 - protein, 9 aa, HIV-1
LRQRKIDRL

SEQ ID NO: 5997 - protein, 15 aa, HIV-1
SALVEMGVEMGHHAP

SEQ ID NO: 5998 - protein, 9 aa, HIV-1
LVEMGVEMG

SEQ ID NO: 5999 - protein, 15 aa, HIV-1
SIVIIEYRKILRQRK

SEQ ID NO: 6000 - protein, 9 aa, HIV-1
IEYRKILRQ

SEQ ID NO: 6001 - protein, 15 aa, HIV-1
SIVIIEYRKILRQRK

SEQ ID NO: 6002 - protein, 9 aa, HIV-1
IIEYRKILR

SEQ ID NO: 6003 - protein, 15 aa, HIV-1
SIVIIEYRKILRQRK

SEQ ID NO: 6004 - protein, 9 aa, HIV-1
VIIEYRKIL

SEQ ID NO: 6005 - protein, 15 aa, HIV-1
VAIIIAIVVWSIVII

SEQ ID NO: 6006 - protein, 9 aa, HIV-1
AIVVWSIVI

SEQ ID NO: 6007 - protein, 15 aa, HIV-1
VAIIIAIVVWSIVII

SEQ ID NO: 6008 - protein, 9 aa, HIV-1
IAIVVWSIV

SEQ ID NO: 6009 - protein, 15 aa, HIV-1
VAIIIAIVVWSIVII

SEQ ID NO: 6010 - protein, 9 aa, HIV-1
IIAIVVWSI

SEQ ID NO: 6011 - protein, 15 aa, HIV-1
VAIIIAIVVWSIVII

SEQ ID NO: 6012 - protein, 9 aa, HIV-1
IIIAIVVWS

SEQ ID NO: 6013 - protein, 15 aa, HIV-1
VAIVALVVAIIIAIV

SEQ ID NO: 6014 - protein, 9 aa, HIV-1
IVALVVAII

SEQ ID NO: 6015 - protein, 15 aa, HIV-1
VAIVALVVAIIIAIV

SEQ ID NO: 6016 - protein, 9 aa, HIV-1
LVVAIIIAI

SEQ ID NO: 6017 - protein, 15 aa, HIV-1
VALVVAIIIAIVVWS

SEQ ID NO: 6018 - protein, 9 aa, HIV-1
LVVAIIIAI

SEQ ID NO: 6019 - protein, 15 aa, HIV-1
VALVVAIIIAIVVWS

SEQ ID NO: 6020 - protein, 9 aa, HIV-1
VAIIIAIVV

SEQ ID NO: 6021 - protein, 15 aa, HIV-1
VALVVAIIIAIVVWS

SEQ ID NO: 6022 - protein, 9 aa, HIV-1
VVAIIIAIV

SEQ ID NO: 6023 - protein, 15 aa, HIV-1
VEMGVEMGHHAPWDV

SEQ ID NO: 6024 - protein, 9 aa, HIV-1
MGVEMGHHA

SEQ ID NO: 6025 - protein, 15 aa, HIV-1
VIIEYRKILRQRKID

SEQ ID NO: 6026 - protein, 9 aa, HIV-1
EYRKILRQR

SEQ ID NO: 6027 - protein, 15 aa, HIV-1
VIIEYRKILRQRKID

SEQ ID NO: 6028 - protein, 9 aa, HIV-1
YRKILRQRK

SEQ ID NO: 6029 - protein, 15 aa, HIV-1
VVAIIIAIVVWSIVI

SEQ ID NO: 6030 - protein, 9 aa, HIV-1
IIAIVVWSI

SEQ ID NO: 6031 - protein, 15 aa, HIV-1
VVAIIIAIVVWSIVI

SEQ ID NO: 6032 - protein, 9 aa, HIV-1
IIIAIVVWS

SEQ ID NO: 6033 - protein, 15 aa, HIV-1
VVWSIVIIEYRKILR

SEQ ID NO: 6034 - protein, 9 aa, HIV-1
WSIVIIEYR

SEQ ID NO: 6035 - protein, 15 aa, HIV-1
VWSIVIIEYRKILRQ

SEQ ID NO: 6036 - protein, 9 aa, HIV-1
IIEYRKILR

SEQ ID NO: 6037 - protein, 15 aa, HIV-1
WSIVIIEYRKILRQR

SEQ ID NO: 6038 - protein, 9 aa, HIV-1
IIEYRKILR

SEQ ID NO: 6039 - protein, 15 aa, HIV-1
YRKILRQRKIDRLID

SEQ ID NO: 6040 - protein, 9 aa, HIV-1
ILRQRKIDR

SEQ ID NO: 6041 - protein, 15 aa, HIV-1
YRKILRQRKIDRLID

SEQ ID NO: 6042 - protein, 9 aa, HIV-1
LRQRKIDRL

SEQ ID NO: 6043 - protein, 15 aa, HIV-1
YRKILRQRKIDRLID

SEQ ID NO: 6044 - protein, 9 aa, HIV-1
YRKILRQRK

SEQ ID NO: 6045 - protein, 8 aa, HIV-1
ELIRTVRL

SEQ ID NO: 6046 - protein, 8 aa, HIV-1
LIRTVRLI

SEQ ID NO: 6047 - protein, 8 aa, HIV-1
RTVRLIKL

SEQ ID NO: 6048 - protein, 8 aa, HIV-1
RLIKLLYQ

SEQ ID NO: 6049 - protein, 8 aa, HIV-1
RQARRNRR

SEQ ID NO: 6050 - protein, 8 aa, HIV-1
QARRNRRR

SEQ ID NO: 6051 - protein, 8 aa, HIV-1
RRNRRRRW

SEQ ID NO: 6052 - protein, 8 aa, HIV-1
RNRRRRWR

SEQ ID NO: 6053 - protein, 8 aa, HIV-1
RRRRWRER

SEQ ID NO: 6054 - protein, 8 aa, HIV-1
RRWRERQR

SEQ ID NO: 6055 - protein, 8 aa, HIV-1
RQRQIHSI

SEQ ID NO: 6056 - protein, 8 aa, HIV-1
RQIHSISE

SEQ ID NO: 6057 - protein, 8 aa, HIV-1
QIHSISER

SEQ ID NO: 6058 - protein, 8 aa, HIV-1
SERILGTY

SEQ ID NO: 6059 - protein, 8 aa, HIV-1
ILGTYLGR

SEQ ID NO: 6060 - protein, 8 aa, HIV-1
RSAEPVPL

SEQ ID NO: 6061 - protein, 8 aa, HIV-1
AEPVPLQL

SEQ ID NO: 6062 - protein, 8 aa, HIV-1
VPLQLPPL

SEQ ID NO: 6063 - protein, 8 aa, HIV-1
LQLPPLER

SEQ ID NO: 6064 - protein, 8 aa, HIV-1
QLPPLERL

SEQ ID NO: 6065 - protein, 8 aa, HIV-1
LPPLERLT

SEQ ID NO: 6066 - protein, 8 aa, HIV-1
PPLERLTL

SEQ ID NO: 6067 - protein, 8 aa, HIV-1
GTSGTQGV

SEQ ID NO: 6068 - protein, 8 aa, HIV-1
VGSPQILV

SEQ ID NO: 6069 - protein, 8 aa, HIV-1
ILVESPTV

SEQ ID NO: 6070 - protein, 8 aa, HIV-1
TVLESGTK

SEQ ID NO: 6071 - protein, 9 aa, HIV-1
EELIRTVRL

SEQ ID NO: 6072 - protein, 9 aa, HIV-1
ELIRTVRLI

SEQ ID NO: 6073 - protein, 9 aa, HIV-1
LIRTVRLIK

SEQ ID NO: 6074 - protein, 9 aa, HIV-1
TVRLIKLLY

SEQ ID NO: 6075 - protein, 9 aa, HIV-1
RLIKLLYQS

SEQ ID NO: 6076 - protein, 9 aa, HIV-1
GTRQARRNR

SEQ ID NO: 6077 - protein, 9 aa, HIV-1
RQARRNRRR

SEQ ID NO: 6078 - protein, 9 aa, HIV-1
QARRNRRRR

SEQ ID NO: 6079 - protein, 9 aa, HIV-1
RRNRRRRWR

SEQ ID NO: 6080 - protein, 9 aa, HIV-1
NRRRRWRER

SEQ ID NO: 6081 - protein, 9 aa, HIV-1
RRRRWRERQ

SEQ ID NO: 6082 - protein, 9 aa, HIV-1
RRRWRERQR

SEQ ID NO: 6083 - protein, 9 aa, HIV-1
RRWRERQRQ

SEQ ID NO: 6084 - protein, 9 aa, HIV-1
RQIHSISER

SEQ ID NO: 6085 - protein, 9 aa, HIV-1
QIHSISERI

SEQ ID NO: 6086 - protein, 9 aa, HIV-1
IHSISERIL

SEQ ID NO: 6087 - protein, 9 aa, HIV-1
SISERILGT

SEQ ID NO: 6088 - protein, 9 aa, HIV-1
ISERILGTY

SEQ ID NO: 6089 - protein, 9 aa, HIV-1
SERILGTYL

SEQ ID NO: 6090 - protein, 9 aa, HIV-1
RILGTYLGR

SEQ ID NO: 6091 - protein, 9 aa, HIV-1
ILGTYLGRS

SEQ ID NO: 6092 - protein, 9 aa, HIV-1
YLGRSAEPV

SEQ ID NO: 6093 - protein, 9 aa, HIV-1
SAEPVPLQL

SEQ ID NO: 6094 - protein, 9 aa, HIV-1
PVPLQLPPL

SEQ ID NO: 6095 - protein, 9 aa, HIV-1
LQLPPLERL

SEQ ID NO: 6096 - protein, 9 aa, HIV-1
QLPPLERLT

SEQ ID NO: 6097 - protein, 9 aa, HIV-1
LPPLERLTL

SEQ ID NO: 6098 - protein, 9 aa, HIV-1
CGTSGTQGV

SEQ ID NO: 6099 - protein, 9 aa, HIV-1
TQGVGSPQI

SEQ ID NO: 6100 - protein, 9 aa, HIV-1
GVGSPQILV

SEQ ID NO: 6101 - protein, 9 aa, HIV-1
QILVESPTV

SEQ ID NO: 6102 - protein, 9 aa, HIV-1
ILVESPTVL

SEQ ID NO: 6103 - protein, 10 aa, HIV-1
DSDEELIRTV

SEQ ID NO: 6104 - protein, 10 aa, HIV-1
DEELIRTVRL

SEQ ID NO: 6105 - protein, 10 aa, HIV-1
ELIRTVRLIK

SEQ ID NO: 6106 - protein, 10 aa, HIV-1
LIRTVRLIKL

SEQ ID NO: 6107 - protein, 10 aa, HIV-1
RTVRLIKLLY

SEQ ID NO: 6108 - protein, 10 aa, HIV-1
GTRQARRNRR

SEQ ID NO: 6109 - protein, 10 aa, HIV-1
TRQARRNRRR

SEQ ID NO: 6110 - protein, 10 aa, HIV-1
RQARRNRRRR

SEQ ID NO: 6111 - protein, 10 aa, HIV-1
ARRNRRRRWR

SEQ ID NO: 6112 - protein, 10 aa, HIV-1
RNRRRRWRER

SEQ ID NO: 6113 - protein, 10 aa, HIV-1
RRRRWRERQR

SEQ ID NO: 6114 - protein, 10 aa, HIV-1
RRWRERQRQI

SEQ ID NO: 6115 - protein, 10 aa, HIV-1
RERQRQIHSI

SEQ ID NO: 6116 - protein, 10 aa, HIV-1
RQIHSISERI

SEQ ID NO: 6117 - protein, 10 aa, HIV-1
SISERILGTY

SEQ ID NO: 6118 - protein, 10 aa, HIV-1
ERILGTYLGR

SEQ ID NO: 6119 - protein, 10 aa, HIV-1
ILGTYLGRSA

SEQ ID NO: 6120 - protein, 10 aa, HIV-1
TYLGRSAEPV

SEQ ID NO: 6121 - protein, 10 aa, HIV-1
RSAEPVPLQL

SEQ ID NO: 6122 - protein, 10 aa, HIV-1
EPVPLQLPPL

SEQ ID NO: 6123 - protein, 10 aa, HIV-1
PLQLPPLERL

SEQ ID NO: 6124 - protein, 10 aa, HIV-1
LQLPPLERLT

SEQ ID NO: 6125 - protein, 10 aa, HIV-1
QLPPLERLTL

SEQ ID NO: 6126 - protein, 10 aa, HIV-1
TLDCNEDCGT

SEQ ID NO: 6127 - protein, 10 aa, HIV-1
QGVGSPQILV

SEQ ID NO: 6128 - protein, 10 aa, HIV-1
PQILVESPTV

SEQ ID NO: 6129 - protein, 11 aa, HIV-1
DSDEELIRTVR

SEQ ID NO: 6130 - protein, 11 aa, HIV-1
ELIRTVRLIKL

SEQ ID NO: 6131 - protein, 11 aa, HIV-1
LIRTVRLIKLL

SEQ ID NO: 6132 - protein, 11 aa, HIV-1
GTRQARRNRRR

SEQ ID NO: 6133 - protein, 11 aa, HIV-1
QARRNRRRRWR

SEQ ID NO: 6134 - protein, 11 aa, HIV-1
RRNRRRRWRER

SEQ ID NO: 6135 - protein, 11 aa, HIV-1
RRRRWRERQRQ

SEQ ID NO: 6136 - protein, 11 aa, HIV-1
RRRWRERQRQI

SEQ ID NO: 6137 - protein, 11 aa, HIV-1
RRWRERQRQIH

SEQ ID NO: 6138 - protein, 11 aa, HIV-1
RQRQIHSISER

SEQ ID NO: 6139 - protein, 11 aa, HIV-1
RQIHSISERIL

SEQ ID NO: 6140 - protein, 11 aa, HIV-1
HSISERILGTY

SEQ ID NO: 6141 - protein, 11 aa, HIV-1
SISERILGTYL

SEQ ID NO: 6142 - protein, 11 aa, HIV-1
RILGTYLGRSA

SEQ ID NO: 6143 - protein, 11 aa, HIV-1
GTYLGRSAEPV

SEQ ID NO: 6144 - protein, 11 aa, HIV-1
YLGRSAEPVPL

SEQ ID NO: 6145 - protein, 11 aa, HIV-1
AEPVPLQLPPL

SEQ ID NO: 6146 - protein, 11 aa, HIV-1
VPLQLPPLERL

SEQ ID NO: 6147 - protein, 11 aa, HIV-1
LQLPPLERLTL

SEQ ID NO: 6148 - protein, 11 aa, HIV-1
TQGVGSPQILV

SEQ ID NO: 6149 - protein, 11 aa, HIV-1
ESPTVLESGTK

SEQ ID NO: 6150 - protein, 15 aa, HIV-1
AEPVPLQLPPLERLT

SEQ ID NO: 6151 - protein, 9 aa, HIV-1
LQLPPLERL

SEQ ID NO: 6152 - protein, 15 aa, HIV-1
AEPVPLQLPPLERLT

SEQ ID NO: 6153 - protein, 9 aa, HIV-1
VPLQLPPLE

SEQ ID NO: 6154 - protein, 15 aa, HIV-1
ARRNRRRRWRERQRQ

SEQ ID NO: 6155 - protein, 9 aa, HIV-1
NRRRRWRER

SEQ ID NO: 6156 - protein, 15 aa, HIV-1
DEELIRTVRLIKLLY

SEQ ID NO: 6157 - protein, 9 aa, HIV-1
IRTVRLIKL

SEQ ID NO: 6158 - protein, 15 aa, HIV-1
DSDEELIRTVRLIKL

SEQ ID NO: 6159 - protein, 9 aa, HIV-1
EELIRTVRL

SEQ ID NO: 6160 - protein, 15 aa, HIV-1
DSDEELIRTVRLIKL

SEQ ID NO: 6161 - protein, 9 aa, HIV-1
LIRTVRLIK

SEQ ID NO: 6162 - protein, 15 aa, HIV-1
EELIRTVRLIKLLYQ

SEQ ID NO: 6163 - protein, 9 aa, HIV-1
IRTVRLIKL

SEQ ID NO: 6164 - protein, 15 aa, HIV-1
EELIRTVRLIKLLYQ

SEQ ID NO: 6165 - protein, 9 aa, HIV-1
LIRTVRLIK

SEQ ID NO: 6166 - protein, 15 aa, HIV-1
EELIRTVRLIKLLYQ

SEQ ID NO: 6167 - protein, 9 aa, HIV-1
TVRLIKLLY

SEQ ID NO: 6168 - protein, 15 aa, HIV-1
EGTRQARRNRRRRWR

SEQ ID NO: 6169 - protein, 9 aa, HIV-1
RQARRNRRR

SEQ ID NO: 6170 - protein, 15 aa, HIV-1
EGTRQARRNRRRRWR

SEQ ID NO: 6171 - protein, 9 aa, HIV-1
TRQARRNRR

SEQ ID NO: 6172 - protein, 15 aa, HIV-1
ELIRTVRLIKLLYQS

SEQ ID NO: 6173 - protein, 9 aa, HIV-1
IRTVRLIKL

SEQ ID NO: 6174 - protein, 15 aa, HIV-1
ELIRTVRLIKLLYQS

SEQ ID NO: 6175 - protein, 9 aa, HIV-1
TVRLIKLLY

SEQ ID NO: 6176 - protein, 15 aa, HIV-1
ELIRTVRLIKLLYQS

SEQ ID NO: 6177 - protein, 9 aa, HIV-1
VRLIKLLYQ

SEQ ID NO: 6178 - protein, 15 aa, HIV-1
EPVPLQLPPLERLTL

SEQ ID NO: 6179 - protein, 9 aa, HIV-1
LQLPPLERL

SEQ ID NO: 6180 - protein, 15 aa, HIV-1
EPVPLQLPPLERLTL

SEQ ID NO: 6181 - protein, 9 aa, HIV-1
VPLQLPPLE

SEQ ID NO: 6182 - protein, 15 aa, HIV-1
ERILGTYLGRSAEPV

SEQ ID NO: 6183 - protein, 9 aa, HIV-1
ILGTYLGRS

SEQ ID NO: 6184 - protein, 15 aa, HIV-1
ERILGTYLGRSAEPV

SEQ ID NO: 6185 - protein, 9 aa, HIV-1
LGTYLGRSA

SEQ ID NO: 6186 - protein, 15 aa, HIV-1
GRSAEPVPLQLPPLE

SEQ ID NO: 6187 - protein, 9 aa, HIV-1
GRSAEPVPL

SEQ ID NO: 6188 - protein, 15 aa, HIV-1
GRSAEPVPLQLPPLE

SEQ ID NO: 6189 - protein, 9 aa, HIV-1
PVPLQLPPL

SEQ ID NO: 6190 - protein, 15 aa, HIV-1
GSPQILVESPTVLES

SEQ ID NO: 6191 - protein, 9 aa, HIV-1
ILVESPTVL

SEQ ID NO: 6192 - protein, 15 aa, HIV-1
GSPQILVESPTVLES

SEQ ID NO: 6193 - protein, 9 aa, HIV-1
LVESPTVLE

SEQ ID NO: 6194 - protein, 15 aa, HIV-1
GTRQARRNRRRRWRE

SEQ ID NO: 6195 - protein, 9 aa, HIV-1
RQARRNRRR

SEQ ID NO: 6196 - protein, 15 aa, HIV-1
GTYLGRSAEPVPLQL

SEQ ID NO: 6197 - protein, 9 aa, HIV-1
YLGRSAEPV

SEQ ID NO: 6198 - protein, 15 aa, HIV-1
GVGSPQILVESPTVL

SEQ ID NO: 6199 - protein, 9 aa, HIV-1
PQILVESPT

SEQ ID NO: 6200 - protein, 15 aa, HIV-1
HSISERILGTYLGRS

SEQ ID NO: 6201 - protein, 9 aa, HIV-1
ERILGTYLG

SEQ ID NO: 6202 - protein, 15 aa, HIV-1
IKLLYQSNPPPNPEG

SEQ ID NO: 6203 - protein, 9 aa, HIV-1
LLYQSNPPP

SEQ ID NO: 6204 - protein, 15 aa, HIV-1
IKLLYQSNPPPNPEG

SEQ ID NO: 6205 - protein, 9 aa, HIV-1
LYQSNPPPN

SEQ ID NO: 6206 - protein, 15 aa, HIV-1
IKLLYQSNPPPNPEG

SEQ ID NO: 6207 - protein, 9 aa, HIV-1
YQSNPPPNP

SEQ ID NO: 6208 - protein, 15 aa, HIV-1
ILGTYLGRSAEPVPL

SEQ ID NO: 6209 - protein, 9 aa, HIV-1
ILGTYLGRS

SEQ ID NO: 6210 - protein, 15 aa, HIV-1
ILGTYLGRSAEPVPL

SEQ ID NO: 6211 - protein, 9 aa, HIV-1
YLGRSAEPV

SEQ ID NO: 6212 - protein, 15 aa, HIV-1
ILVESPTVLESGTKE

SEQ ID NO: 6213 - protein, 9 aa, HIV-1
ILVESPTVL

SEQ ID NO: 6214 - protein, 15 aa, HIV-1
ILVESPTVLESGTKE

SEQ ID NO: 6215 - protein, 9 aa, HIV-1
LVESPTVLE

SEQ ID NO: 6216 - protein, 15 aa, HIV-1
IRTVRLIKLLYQSNP

SEQ ID NO: 6217 - protein, 9 aa, HIV-1
IRTVRLIKL

SEQ ID NO: 6218 - protein, 15 aa, HIV-1
IRTVRLIKLLYQSNP

SEQ ID NO: 6219 - protein, 9 aa, HIV-1
TVRLIKLLY

SEQ ID NO: 6220 - protein, 15 aa, HIV-1
IRTVRLIKLLYQSNP

SEQ ID NO: 6221 - protein, 9 aa, HIV-1
VRLIKLLYQ

SEQ ID NO: 6222 - protein, 15 aa, HIV-1
ISERILGTYLGRSAE

SEQ ID NO: 6223 - protein, 9 aa, HIV-1
ERILGTYLG

SEQ ID NO: 6224 - protein, 15 aa, HIV-1
ISERILGTYLGRSAE

SEQ ID NO: 6225 - protein, 9 aa, HIV-1
ILGTYLGRS

SEQ ID NO: 6226 - protein, 15 aa, HIV-1
ISERILGTYLGRSAE

SEQ ID NO: 6227 - protein, 9 aa, HIV-1
LGTYLGRSA

SEQ ID NO: 6228 - protein, 15 aa, HIV-1
KLLYQSNPPPNPEGT

SEQ ID NO: 6229 - protein, 9 aa, HIV-1
LYQSNPPPN

SEQ ID NO: 6230 - protein, 15 aa, HIV-1
KLLYQSNPPPNPEGT

SEQ ID NO: 6231 - protein, 9 aa, HIV-1
YQSNPPPNP

SEQ ID NO: 6232 - protein, 15 aa, HIV-1
LGTYLGRSAEPVPLQ

SEQ ID NO: 6233 - protein, 9 aa, HIV-1
YLGRSAEPV

SEQ ID NO: 6234 - protein, 15 aa, HIV-1
LIKLLYQSNPPPNPE

SEQ ID NO: 6235 - protein, 9 aa, HIV-1
LLYQSNPPP

SEQ ID NO: 6236 - protein, 15 aa, HIV-1
LIKLLYQSNPPPNPE

SEQ ID NO: 6237 - protein, 9 aa, HIV-1
LYQSNPPPN

SEQ ID NO: 6238 - protein, 15 aa, HIV-1
LIKLLYQSNPPPNPE

SEQ ID NO: 6239 - protein, 9 aa, HIV-1
YQSNPPPNP

SEQ ID NO: 6240 - protein, 15 aa, HIV-1
LIRTVRLIKLLYQSN

SEQ ID NO: 6241 - protein, 9 aa, HIV-1
IRTVRLIKL

SEQ ID NO: 6242 - protein, 15 aa, HIV-1
LIRTVRLIKLLYQSN

SEQ ID NO: 6243 - protein, 9 aa, HIV-1
TVRLIKLLY

SEQ ID NO: 6244 - protein, 15 aa, HIV-1
LIRTVRLIKLLYQSN

SEQ ID NO: 6245 - protein, 9 aa, HIV-1
VRLIKLLYQ

SEQ ID NO: 6246 - protein, 15 aa, HIV-1
LLYQSNPPPNPEGTR

SEQ ID NO: 6247 - protein, 9 aa, HIV-1
YQSNPPPNP

SEQ ID NO: 6248 - protein, 15 aa, HIV-1
LPPLERLTLDCNEDC

SEQ ID NO: 6249 - protein, 9 aa, HIV-1
LERLTLDCN

SEQ ID NO: 6250 - protein, 15 aa, HIV-1
LQLPPLERLTLDCNE

SEQ ID NO: 6251 - protein, 9 aa, HIV-1
LERLTLDCN

SEQ ID NO: 6252 - protein, 15 aa, HIV-1
LQLPPLERLTLDCNE

SEQ ID NO: 6253 - protein, 9 aa, HIV-1
LQLPPLERL

SEQ ID NO: 6254 - protein, 15 aa, HIV-1
LYQSNPPPNPEGTRQ

SEQ ID NO: 6255 - protein, 9 aa, HIV-1
YQSNPPPNP

SEQ ID NO: 6256 - protein, 15 aa, HIV-1
NPEGTRQARRNRRRR

SEQ ID NO: 6257 - protein, 9 aa, HIV-1
TRQARRNRR

SEQ ID NO: 6258 - protein, 15 aa, HIV-1
NRRRRWRERQRQIHS

SEQ ID NO: 6259 - protein, 9 aa, HIV-1
RRRWRERQR

SEQ ID NO: 6260 - protein, 15 aa, HIV-1
NRRRRWRERQRQIHS

SEQ ID NO: 6261 - protein, 9 aa, HIV-1
WRERQRQIH

SEQ ID NO: 6262 - protein, 15 aa, HIV-1
PEGTRQARRNRRRRW

SEQ ID NO: 6263 - protein, 9 aa, HIV-1
TRQARRNRR

SEQ ID NO: 6264 - protein, 15 aa, HIV-1
PLQLPPLERLTLDCN

SEQ ID NO: 6265 - protein, 9 aa, HIV-1
LQLPPLERL

SEQ ID NO: 6266 - protein, 15 aa, HIV-1
PNPEGTRQARRNRRR

SEQ ID NO: 6267 - protein, 9 aa, HIV-1
TRQARRNRR

SEQ ID NO: 6268 - protein, 15 aa, HIV-1
PPLERLTLDCNEDCG

SEQ ID NO: 6269 - protein, 9 aa, HIV-1
LERLTLDCN

SEQ ID NO: 6270 - protein, 15 aa, HIV-1
PPNPEGTRQARRNRR

SEQ ID NO: 6271 - protein, 9 aa, HIV-1
EGTRQARRN

SEQ ID NO: 6272 - protein, 15 aa, HIV-1
PQILVESPTVLESGT

SEQ ID NO: 6273 - protein, 9 aa, HIV-1
ILVESPTVL

SEQ ID NO: 6274 - protein, 15 aa, HIV-1
PQILVESPTVLESGT

SEQ ID NO: 6275 - protein, 9 aa, HIV-1
LVESPTVLE

SEQ ID NO: 6276 - protein, 15 aa, HIV-1
PVPLQLPPLERLTLD

SEQ ID NO: 6277 - protein, 9 aa, HIV-1
LQLPPLERL

SEQ ID NO: 6278 - protein, 15 aa, HIV-1
PVPLQLPPLERLTLD

SEQ ID NO: 6279 - protein, 9 aa, HIV-1
VPLQLPPLE

SEQ ID NO: 6280 - protein, 15 aa, HIV-1
QARRNRRRRWRERQR

SEQ ID NO: 6281 - protein, 9 aa, HIV-1
NRRRRWRER

SEQ ID NO: 6282 - protein, 15 aa, HIV-1
QILVESPTVLESGTK

SEQ ID NO: 6283 - protein, 9 aa, HIV-1
LVESPTVLE

SEQ ID NO: 6284 - protein, 15 aa, HIV-1
QLPPLERLTLDCNED

SEQ ID NO: 6285 - protein, 9 aa, HIV-1
LERLTLDCN

SEQ ID NO: 6286 - protein, 15 aa, HIV-1
RILGTYLGRSAEPVP

SEQ ID NO: 6287 - protein, 9 aa, HIV-1
ILGTYLGRS

SEQ ID NO: 6288 - protein, 15 aa, HIV-1
RILGTYLGRSAEPVP

SEQ ID NO: 6289 - protein, 9 aa, HIV-1
YLGRSAEPV

SEQ ID NO: 6290 - protein, 15 aa, HIV-1
RLIKLLYQSNPPPNP

SEQ ID NO: 6291 - protein, 9 aa, HIV-1
LIKLLYQSN

SEQ ID NO: 6292 - protein, 15 aa, HIV-1
RLIKLLYQSNPPPNP

SEQ ID NO: 6293 - protein, 9 aa, HIV-1
LLYQSNPPP

SEQ ID NO: 6294 - protein, 15 aa, HIV-1
RLIKLLYQSNPPPNP

SEQ ID NO: 6295 - protein, 9 aa, HIV-1
LYQSNPPPN

SEQ ID NO: 6296 - protein, 15 aa, HIV-1
RNRRRRWRERQRQIH

SEQ ID NO: 6297 - protein, 9 aa, HIV-1
RRRWRERQR

SEQ ID NO: 6298 - protein, 15 aa, HIV-1
RQARRNRRRRWRERQ

SEQ ID NO: 6299 - protein, 9 aa, HIV-1
NRRRRWRER

SEQ ID NO: 6300 - protein, 15 aa, HIV-1
RQARRNRRRRWRERQ

SEQ ID NO: 6301 - protein, 9 aa, HIV-1
RRNRRRRWR

SEQ ID NO: 6302 - protein, 15 aa, HIV-1
RRNRRRRWRERQRQI

SEQ ID NO: 6303 - protein, 9 aa, HIV-1
NRRRRWRER

SEQ ID NO: 6304 - protein, 15 aa, HIV-1
RRRRWRERQRQIHSI

SEQ ID NO: 6305 - protein, 9 aa, HIV-1
WRERQRQIH

SEQ ID NO: 6306 - protein, 15 aa, HIV-1
RRRWRERQRQIHSIS

SEQ ID NO: 6307 - protein, 9 aa, HIV-1
WRERQRQIH

SEQ ID NO: 6308 - protein, 15 aa, HIV-1
RRWRERQRQIHSISE

SEQ ID NO: 6309 - protein, 9 aa, HIV-1
WRERQRQIH

SEQ ID NO: 6310 - protein, 15 aa, HIV-1
RSAEPVPLQLPPLER

SEQ ID NO: 6311 - protein, 9 aa, HIV-1
VPLQLPPLE

SEQ ID NO: 6312 - protein, 15 aa, HIV-1
RTVRLIKLLYQSNPP

SEQ ID NO: 6313 - protein, 9 aa, HIV-1
IKLLYQSNP

SEQ ID NO: 6314 - protein, 15 aa, HIV-1
RTVRLIKLLYQSNPP

SEQ ID NO: 6315 - protein, 9 aa, HIV-1
VRLIKLLYQ

SEQ ID NO: 6316 - protein, 15 aa, HIV-1
SAEPVPLQLPPLERL

SEQ ID NO: 6317 - protein, 9 aa, HIV-1
PVPLQLPPL

SEQ ID NO: 6318 - protein, 15 aa, HIV-1
SAEPVPLQLPPLERL

SEQ ID NO: 6319 - protein, 9 aa, HIV-1
VPLQLPPLE

SEQ ID NO: 6320 - protein, 15 aa, HIV-1
SDEELIRTVRLIKLL

SEQ ID NO: 6321 - protein, 9 aa, HIV-1
IRTVRLIKL

SEQ ID NO: 6322 - protein, 15 aa, HIV-1
SERILGTYLGRSAEP

SEQ ID NO: 6323 - protein, 9 aa, HIV-1
ILGTYLGRS

SEQ ID NO: 6324 - protein, 15 aa, HIV-1
SERILGTYLGRSAEP

SEQ ID NO: 6325 - protein, 9 aa, HIV-1
LGTYLGRSA

SEQ ID NO: 6326 - protein, 15 aa, HIV-1
SISERILGTYLGRSA

SEQ ID NO: 6327 - protein, 9 aa, HIV-1
ERILGTYLG

SEQ ID NO: 6328 - protein, 15 aa, HIV-1
SISERILGTYLGRSA

SEQ ID NO: 6329 - protein, 9 aa, HIV-1
ILGTYLGRS

SEQ ID NO: 6330 - protein, 15 aa, HIV-1
SPQILVESPTVLESG

SEQ ID NO: 6331 - protein, 9 aa, HIV-1
ILVESPTVL

SEQ ID NO: 6332 - protein, 15 aa, HIV-1
SPQILVESPTVLESG

SEQ ID NO: 6333 - protein, 9 aa, HIV-1
LVESPTVLE

SEQ ID NO: 6334 - protein, 15 aa, HIV-1
TRQARRNRRRRWRER

SEQ ID NO: 6335 - protein, 9 aa, HIV-1
RRNRRRRWR

SEQ ID NO: 6336 - protein, 15 aa, HIV-1
TVRLIKLLYQSNPPP

SEQ ID NO: 6337 - protein, 9 aa, HIV-1
IKLLYQSNP

SEQ ID NO: 6338 - protein, 15 aa, HIV-1
TVRLIKLLYQSNPPP

SEQ ID NO: 6339 - protein, 9 aa, HIV-1
VRLIKLLYQ

SEQ ID NO: 6340 - protein, 15 aa, HIV-1
TYLGRSAEPVPLQLP

SEQ ID NO: 6341 - protein, 9 aa, HIV-1
YLGRSAEPV

SEQ ID NO: 6342 - protein, 15 aa, HIV-1
VGSPQILVESPTVLE

SEQ ID NO: 6343 - protein, 9 aa, HIV-1
ILVESPTVL

SEQ ID NO: 6344 - protein, 15 aa, HIV-1
VGSPQILVESPTVLE

SEQ ID NO: 6345 - protein, 9 aa, HIV-1
VGSPQILVE

SEQ ID NO: 6346 - protein, 15 aa, HIV-1
VPLQLPPLERLTLDC

SEQ ID NO: 6347 - protein, 9 aa, HIV-1
LQLPPLERL

SEQ ID NO: 6348 - protein, 15 aa, HIV-1
VPLQLPPLERLTLDC

SEQ ID NO: 6349 - protein, 9 aa, HIV-1
VPLQLPPLE

SEQ ID NO: 6350 - protein, 15 aa, HIV-1
VRLIKLLYQSNPPPN

SEQ ID NO: 6351 - protein, 9 aa, HIV-1
LLYQSNPPP

SEQ ID NO: 6352 - protein, 15 aa, HIV-1
YLGRSAEPVPLQLPP

SEQ ID NO: 6353 - protein, 9 aa, HIV-1
YLGRSAEPV

SEQ ID NO: 6354 - protein, 15 aa, HIV-1
YQSNPPPNPEGTRQA

SEQ ID NO: 6355 - protein, 9 aa, HIV-1
YQSNPPPNP

SEQ ID NO: 6356 - protein, 8 aa, HIV-1
EPHNEWTL

SEQ ID NO: 6357 - protein, 8 aa, HIV-1
HNEWTLEL

SEQ ID NO: 6358 - protein, 8 aa, HIV-1
NEWTLELL

SEQ ID NO: 6359 - protein, 8 aa, HIV-1
TLELLEEL

SEQ ID NO: 6360 - protein, 8 aa, HIV-1
EELKNEAV

SEQ ID NO: 6361 - protein, 8 aa, HIV-1
ELKNEAVR

SEQ ID NO: 6362 - protein, 8 aa, HIV-1
EAVRHFPR

SEQ ID NO: 6363 - protein, 8 aa, HIV-1
AVRHFPRI

SEQ ID NO: 6364 - protein, 8 aa, HIV-1
GQHIYETY

SEQ ID NO: 6365 - protein, 8 aa, HIV-1
ETYGDTWA

SEQ ID NO: 6366 - protein, 8 aa, HIV-1
YGDTWAGV

SEQ ID NO: 6367 - protein, 8 aa, HIV-1
DTWAGVEA

SEQ ID NO: 6368 - protein, 8 aa, HIV-1
TWAGVEAI

SEQ ID NO: 6369 - protein, 8 aa, HIV-1
VEAIIRIL

SEQ ID NO: 6370 - protein, 8 aa, HIV-1
RILQQLLF

SEQ ID NO: 6371 - protein, 8 aa, HIV-1
ILQQLLFI

SEQ ID NO: 6372 - protein, 8 aa, HIV-1
QQLLFIHF

SEQ ID NO: 6373 - protein, 8 aa, HIV-1
QLLFIHFR

SEQ ID NO: 6374 - protein, 8 aa, HIV-1
LLFIHFRI

SEQ ID NO: 6375 - protein, 8 aa, HIV-1
RIGCRHSR

SEQ ID NO: 6376 - protein, 8 aa, HIV-1
HSRIGVTR

SEQ ID NO: 6377 - protein, 8 aa, HIV-1
RIGVTRQR

SEQ ID NO: 6378 - protein, 8 aa, HIV-1
VTRQRRAR

SEQ ID NO: 6379 - protein, 8 aa, HIV-1
RARNGASR

SEQ ID NO: 6380 - protein, 9 aa, HIV-1
REPHNEWTL

SEQ ID NO: 6381 - protein, 9 aa, HIV-1
PHNEWTLEL

SEQ ID NO: 6382 - protein, 9 aa, HIV-1
WTLELLEEL

SEQ ID NO: 6383 - protein, 9 aa, HIV-1
TLELLEELK

SEQ ID NO: 6384 - protein, 9 aa, HIV-1
LLEELKNEA

SEQ ID NO: 6385 - protein, 9 aa, HIV-1
NEAVRHFPR

SEQ ID NO: 6386 - protein, 9 aa, HIV-1
EAVRHFPRI

SEQ ID NO: 6387 - protein, 9 aa, HIV-1
FPRIWLHGL

SEQ ID NO: 6388 - protein, 9 aa, HIV-1
WLHGLGQHI

SEQ ID NO: 6389 - protein, 9 aa, HIV-1
GLGQHIYET

SEQ ID NO: 6390 - protein, 9 aa, HIV-1
IYETYGDTW

SEQ ID NO: 6391 - protein, 9 aa, HIV-1
YETYGDTWA

SEQ ID NO: 6392 - protein, 9 aa, HIV-1
ETYGDTWAG

SEQ ID NO: 6393 - protein, 9 aa, HIV-1
TYGDTWAGV

SEQ ID NO: 6394 - protein, 9 aa, HIV-1
DTWAGVEAI

SEQ ID NO: 6395 - protein, 9 aa, HIV-1
TWAGVEAII

SEQ ID NO: 6396 - protein, 9 aa, HIV-1
AIIRILQQL

SEQ ID NO: 6397 - protein, 9 aa, HIV-1
IRILQQLLF

SEQ ID NO: 6398 - protein, 9 aa, HIV-1
RILQQLLFI

SEQ ID NO: 6399 - protein, 9 aa, HIV-1
LQQLLFIHF

SEQ ID NO: 6400 - protein, 9 aa, HIV-1
QQLLFIHFR

SEQ ID NO: 6401 - protein, 9 aa, HIV-1
QLLFIHFRI

SEQ ID NO: 6402 - protein, 9 aa, HIV-1
FIHFRIGCR

SEQ ID NO: 6403 - protein, 9 aa, HIV-1
FRIGCRHSR

SEQ ID NO: 6404 - protein, 9 aa, HIV-1
RIGCRHSRI

SEQ ID NO: 6405 - protein, 9 aa, HIV-1
RHSRIGVTR

SEQ ID NO: 6406 - protein, 9 aa, HIV-1
SRIGVTRQR

SEQ ID NO: 6407 - protein, 9 aa, HIV-1
RIGVTRQRR

SEQ ID NO: 6408 - protein, 9 aa, HIV-1
GVTRQRRAR

SEQ ID NO: 6409 - protein, 9 aa, HIV-1
RQRRARNGA

SEQ ID NO: 6410 - protein, 9 aa, HIV-1
RRARNGASR

SEQ ID NO: 6411 - protein, 10 aa, HIV-1
QAPEDQGPQR

SEQ ID NO: 6412 - protein, 10 aa, HIV-1
EPHNEWTLEL

SEQ ID NO: 6413 - protein, 10 aa, HIV-1
WTLELLEELK

SEQ ID NO: 6414 - protein, 10 aa, HIV-1
ELLEELKNEA

SEQ ID NO: 6415 - protein, 10 aa, HIV-1
LLEELKNEAV

SEQ ID NO: 6416 - protein, 10 aa, HIV-1
ELKNEAVRHF

SEQ ID NO: 6417 - protein, 10 aa, HIV-1
KNEAVRHFPR

SEQ ID NO: 6418 - protein, 10 aa, HIV-1
EAVRHFPRIW

SEQ ID NO: 6419 - protein, 10 aa, HIV-1
AVRHFPRIWL

SEQ ID NO: 6420 - protein, 10 aa, HIV-1
HFPRIWLHGL

SEQ ID NO: 6421 - protein, 10 aa, HIV-1
FPRIWLHGLG

SEQ ID NO: 6422 - protein, 10 aa, HIV-1
IWLHGLGQHI

SEQ ID NO: 6423 - protein, 10 aa, HIV-1
WLHGLGQHIY

SEQ ID NO: 6424 - protein, 10 aa, HIV-1
GLGQHIYETY

SEQ ID NO: 6425 - protein, 10 aa, HIV-1
HIYETYGDTW

SEQ ID NO: 6426 - protein, 10 aa, HIV-1
ETYGDTWAGV

SEQ ID NO: 6427 - protein, 10 aa, HIV-1
DTWAGVEAII

SEQ ID NO: 6428 - protein, 10 aa, HIV-1
TWAGVEAIIR

SEQ ID NO: 6429 - protein, 10 aa, HIV-1
EAIIRILQQL

SEQ ID NO: 6430 - protein, 10 aa, HIV-1
AIIRILQQLL

SEQ ID NO: 6431 - protein, 10 aa, HIV-1
ILQQLLFIHF

SEQ ID NO: 6432 - protein, 10 aa, HIV-1
LQQLLFIHFR

SEQ ID NO: 6433 - protein, 10 aa, HIV-1
QQLLFIHFRI

SEQ ID NO: 6434 - protein, 10 aa, HIV-1
LLFIHFRIGC

SEQ ID NO: 6435 - protein, 10 aa, HIV-1
LFIHFRIGCR

SEQ ID NO: 6436 - protein, 10 aa, HIV-1
HFRIGCRHSR

SEQ ID NO: 6437 - protein, 10 aa, HIV-1
FRIGCRHSRI

SEQ ID NO: 6438 - protein, 10 aa, HIV-1
CRHSRIGVTR

SEQ ID NO: 6439 - protein, 10 aa, HIV-1
HSRIGVTRQR

SEQ ID NO: 6440 - protein, 10 aa, HIV-1
SRIGVTRQRR

SEQ ID NO: 6441 - protein, 10 aa, HIV-1
QRRARNGASR

SEQ ID NO: 6442 - protein, 11 aa, HIV-1
EQAPEDQGPQR

SEQ ID NO: 6443 - protein, 11 aa, HIV-1
REPHNEWTLEL

SEQ ID NO: 6444 - protein, 11 aa, HIV-1
EPHNEWTLELL

SEQ ID NO: 6445 - protein, 11 aa, HIV-1
NEWTLELLEEL

SEQ ID NO: 6446 - protein, 11 aa, HIV-1
ELLEELKNEAV

SEQ ID NO: 6447 - protein, 11 aa, HIV-1
EELKNEAVRHF

SEQ ID NO: 6448 - protein, 11 aa, HIV-1
EAVRHFPRIWL

SEQ ID NO: 6449 - protein, 11 aa, HIV-1
RHFPRIWLHGL

SEQ ID NO: 6450 - protein, 11 aa, HIV-1
RIWLHGLGQHI

SEQ ID NO: 6451 - protein, 11 aa, HIV-1
IWLHGLGQHIY

SEQ ID NO: 6452 - protein, 11 aa, HIV-1
WLHGLGQHIYE

SEQ ID NO: 6453 - protein, 11 aa, HIV-1
HIYETYGDTWA

SEQ ID NO: 6454 - protein, 11 aa, HIV-1
YETYGDTWAGV

SEQ ID NO: 6455 - protein, 11 aa, HIV-1
ETYGDTWAGVE

SEQ ID NO: 6456 - protein, 11 aa, HIV-1
DTWAGVEAIIR

SEQ ID NO: 6457 - protein, 11 aa, HIV-1
TWAGVEAIIRI

SEQ ID NO: 6458 - protein, 11 aa, HIV-1
VEAIIRILQQL

SEQ ID NO: 6459 - protein, 11 aa, HIV-1
EAIIRILQQLL

SEQ ID NO: 6460 - protein, 11 aa, HIV-1
AIIRILQQLLF

SEQ ID NO: 6461 - protein, 11 aa, HIV-1
IIRILQQLLFI

SEQ ID NO: 6462 - protein, 11 aa, HIV-1
RILQQLLFIHF

SEQ ID NO: 6463 - protein, 11 aa, HIV-1
ILQQLLFIHFR

SEQ ID NO: 6464 - protein, 11 aa, HIV-1
LQQLLFIHFRI

SEQ ID NO: 6465 - protein, 11 aa, HIV-1
QLLFIHFRIGC

SEQ ID NO: 6466 - protein, 11 aa, HIV-1
LLFIHFRIGCR

SEQ ID NO: 6467 - protein, 11 aa, HIV-1
IHFRIGCRHSR

SEQ ID NO: 6468 - protein, 11 aa, HIV-1
RIGCRHSRIGV

SEQ ID NO: 6469 - protein, 11 aa, HIV-1
GCRHSRIGVTR

SEQ ID NO: 6470 - protein, 11 aa, HIV-1
HSRIGVTRQRR

SEQ ID NO: 6471 - protein, 11 aa, HIV-1
RIGVTRQRRAR

SEQ ID NO: 6472 - protein, 11 aa, HIV-1
RQRRARNGASR

SEQ ID NO: 6473 - protein, 15 aa, HIV-1
AGVEAIIRILQQLLF

SEQ ID NO: 6474 - protein, 9 aa, HIV-1
VEAIIRILQ

SEQ ID NO: 6475 - protein, 15 aa, HIV-1
AIIRILQQLLFIHFR

SEQ ID NO: 6476 - protein, 9 aa, HIV-1
ILQQLLFIH

SEQ ID NO: 6477 - protein, 15 aa, HIV-1
AIIRILQQLLFIHFR

SEQ ID NO: 6478 - protein, 9 aa, HIV-1
IRILQQLLF

SEQ ID NO: 6479 - protein, 15 aa, HIV-1
AIIRILQQLLFIHFR

SEQ ID NO: 6480 - protein, 9 aa, HIV-1
LQQLLFIHF

SEQ ID NO: 6481 - protein, 15 aa, HIV-1
DTWAGVEAIIRILQQ

SEQ ID NO: 6482 - protein, 9 aa, HIV-1
WAGVEAIIR

SEQ ID NO: 6483 - protein, 15 aa, HIV-1
EAIIRILQQLLFIHF

SEQ ID NO: 6484 - protein, 9 aa, HIV-1
IIRILQQLL

SEQ ID NO: 6485 - protein, 15 aa, HIV-1
EAIIRILQQLLFIHF

SEQ ID NO: 6486 - protein, 9 aa, HIV-1
ILQQLLFIH

SEQ ID NO: 6487 - protein, 15 aa, HIV-1
EAIIRILQQLLFIHF

SEQ ID NO: 6488 - protein, 9 aa, HIV-1
IRILQQLLF

SEQ ID NO: 6489 - protein, 15 aa, HIV-1
EAVRHFPRIWLHGLG

SEQ ID NO: 6490 - protein, 9 aa, HIV-1
VRHFPRIWL

SEQ ID NO: 6491 - protein, 15 aa, HIV-1
EELKNEAVRHFPRIW

SEQ ID NO: 6492 - protein, 9 aa, HIV-1
LKNEAVRHF

SEQ ID NO: 6493 - protein, 15 aa, HIV-1
ELKNEAVRHFPRIWL

SEQ ID NO: 6494 - protein, 9 aa, HIV-1
LKNEAVRHF

SEQ ID NO: 6495 - protein, 15 aa, HIV-1
ELKNEAVRHFPRIWL

SEQ ID NO: 6496 - protein, 9 aa, HIV-1
NEAVRHFPR

SEQ ID NO: 6497 - protein, 15 aa, HIV-1
ELLEELKNEAVRHFP

SEQ ID NO: 6498 - protein, 9 aa, HIV-1
LKNEAVRHF

SEQ ID NO: 6499 - protein, 15 aa, HIV-1
ETYGDTWAGVEAIIR

SEQ ID NO: 6500 - protein, 9 aa, HIV-1
DTWAGVEAI

SEQ ID NO: 6501 - protein, 15 aa, HIV-1
FIHFRIGCRHSRIGV

SEQ ID NO: 6502 - protein, 9 aa, HIV-1
FIHFRIGCR

SEQ ID NO: 6503 - protein, 15 aa, HIV-1
FPRIWLHGLGQHIYE

SEQ ID NO: 6504 - protein, 9 aa, HIV-1
IWLHGLGQH

SEQ ID NO: 6505 - protein, 15 aa, HIV-1
FPRIWLHGLGQHIYE

SEQ ID NO: 6506 - protein, 9 aa, HIV-1
WLHGLGQHI

SEQ ID NO: 6507 - protein, 15 aa, HIV-1
GDTWAGVEAIIRILQ

SEQ ID NO: 6508 - protein, 9 aa, HIV-1
WAGVEAIIR

SEQ ID NO: 6509 - protein, 15 aa, HIV-1
GVEAIIRILQQLLFI

SEQ ID NO: 6510 - protein, 9 aa, HIV-1
IRILQQLLF

SEQ ID NO: 6511 - protein, 15 aa, HIV-1
HFPRIWLHGLGQHIY

SEQ ID NO: 6512 - protein, 9 aa, HIV-1
IWLHGLGQH

SEQ ID NO: 6513 - protein, 15 aa, HIV-1
HFPRIWLHGLGQHIY

SEQ ID NO: 6514 - protein, 9 aa, HIV-1
WLHGLGQHI

SEQ ID NO: 6515 - protein, 15 aa, HIV-1
IIRILQQLLFIHFRI

SEQ ID NO: 6516 - protein, 9 aa, HIV-1
ILQQLLFIH

SEQ ID NO: 6517 - protein, 15 aa, HIV-1
IIRILQQLLFIHFRI

SEQ ID NO: 6518 - protein, 9 aa, HIV-1
IRILQQLLF

SEQ ID NO: 6519 - protein, 15 aa, HIV-1
IIRILQQLLFIHFRI

SEQ ID NO: 6520 - protein, 9 aa, HIV-1
LQQLLFIHF

SEQ ID NO: 6521 - protein, 15 aa, HIV-1
ILQQLLFIHFRIGCR

SEQ ID NO: 6522 - protein, 9 aa, HIV-1
ILQQLLFIH

SEQ ID NO: 6523 - protein, 15 aa, HIV-1
ILQQLLFIHFRIGCR

SEQ ID NO: 6524 - protein, 9 aa, HIV-1
LLFIHFRIG

SEQ ID NO: 6525 - protein, 15 aa, HIV-1
IRILQQLLFIHFRIG

SEQ ID NO: 6526 - protein, 9 aa, HIV-1
ILQQLLFIH

SEQ ID NO: 6527 - protein, 15 aa, HIV-1
IRILQQLLFIHFRIG

SEQ ID NO: 6528 - protein, 9 aa, HIV-1
IRILQQLLF

SEQ ID NO: 6529 - protein, 15 aa, HIV-1
KNEAVRHFPRIWLHG

SEQ ID NO: 6530 - protein, 9 aa, HIV-1
VRHFPRIWL

SEQ ID NO: 6531 - protein, 15 aa, HIV-1
LEELKNEAVRHFPRI

SEQ ID NO: 6532 - protein, 9 aa, HIV-1
LKNEAVRHF

SEQ ID NO: 6533 - protein, 15 aa, HIV-1
LELLEELKNEAVRHF

SEQ ID NO: 6534 - protein, 9 aa, HIV-1
ELKNEAVRH

SEQ ID NO: 6535 - protein, 15 aa, HIV-1
LELLEELKNEAVRHF

SEQ ID NO: 6536 - protein, 9 aa, HIV-1
LEELKNEAV

SEQ ID NO: 6537 - protein, 15 aa, HIV-1
LFIHFRIGCRHSRIG

SEQ ID NO: 6538 - protein, 9 aa, HIV-1
FIHFRIGCR

SEQ ID NO: 6539 - protein, 15 aa, HIV-1
LKNEAVRHFPRIWLH

SEQ ID NO: 6540 - protein, 9 aa, HIV-1
LKNEAVRHF

SEQ ID NO: 6541 - protein, 15 aa, HIV-1
LKNEAVRHFPRIWLH

SEQ ID NO: 6542 - protein, 9 aa, HIV-1
VRHFPRIWL

SEQ ID NO: 6543 - protein, 15 aa, HIV-1
LLEELKNEAVRHFPR

SEQ ID NO: 6544 - protein, 9 aa, HIV-1
LKNEAVRHF

SEQ ID NO: 6545 - protein, 15 aa, HIV-1
LLFIHFRIGCRHSRI

SEQ ID NO: 6546 - protein, 9 aa, HIV-1
FIHFRIGCR

SEQ ID NO: 6547 - protein, 15 aa, HIV-1
LQQLLFIHFRIGCRH

SEQ ID NO: 6548 - protein, 9 aa, HIV-1
FIHFRIGCR

SEQ ID NO: 6549 - protein, 15 aa, HIV-1
NEAVRHFPRIWLHGL

SEQ ID NO: 6550 - protein, 9 aa, HIV-1
VRHFPRIWL

SEQ ID NO: 6551 - protein, 15 aa, HIV-1
PRIWLHGLGQHIYET

SEQ ID NO: 6552 - protein, 9 aa, HIV-1
WLHGLGQHI

SEQ ID NO: 6553 - protein, 15 aa, HIV-1
QLLFIHFRIGCRHSR

SEQ ID NO: 6554 - protein, 9 aa, HIV-1
FIHFRIGCR

SEQ ID NO: 6555 - protein, 15 aa, HIV-1
QQLLFIHFRIGCRHS

SEQ ID NO: 6556 - protein, 9 aa, HIV-1
FIHFRIGCR

SEQ ID NO: 6557 - protein, 15 aa, HIV-1
RHFPRIWLHGLGQHI

SEQ ID NO: 6558 - protein, 9 aa, HIV-1
FPRIWLHGL

SEQ ID NO: 6559 - protein, 15 aa, HIV-1
RHFPRIWLHGLGQHI

SEQ ID NO: 6560 - protein, 9 aa, HIV-1
IWLHGLGQH

SEQ ID NO: 6561 - protein, 15 aa, HIV-1
RILQQLLFIHFRIGC

SEQ ID NO: 6562 - protein, 9 aa, HIV-1
ILQQLLFIH

SEQ ID NO: 6563 - protein, 15 aa, HIV-1
RIWLHGLGQHIYETY

SEQ ID NO: 6564 - protein, 9 aa, HIV-1
WLHGLGQHI

SEQ ID NO: 6565 - protein, 15 aa, HIV-1
TYGDTWAGVEAIIRI

SEQ ID NO: 6566 - protein, 9 aa, HIV-1
WAGVEAIIR

SEQ ID NO: 6567 - protein, 15 aa, HIV-1
VEAIIRILQQLLFIH

SEQ ID NO: 6568 - protein, 9 aa, HIV-1
IRILQQLLF

SEQ ID NO: 6569 - protein, 15 aa, HIV-1
VRHFPRIWLHGLGQH

SEQ ID NO: 6570 - protein, 9 aa, HIV-1
FPRIWLHGL

SEQ ID NO: 6571 - protein, 15 aa, HIV-1
WAGVEAIIRILQQLL

SEQ ID NO: 6572 - protein, 9 aa, HIV-1
WAGVEAIIR

SEQ ID NO: 6573 - protein, 15 aa, HIV-1
YGDTWAGVEAIIRIL

SEQ ID NO: 6574 - protein, 9 aa, HIV-1
WAGVEAIIR

SEQ ID NO: 6575 - protein, 8 aa, HIV-1
RVKEKYQH

SEQ ID NO: 6576 - protein, 8 aa, HIV-1
KEKYQHLW

SEQ ID NO: 6577 - protein, 8 aa, HIV-1
EKYQHLWR

SEQ ID NO: 6578 - protein, 8 aa, HIV-1
KYQHLWRW

SEQ ID NO: 6579 - protein, 8 aa, HIV-1
HLWRWGWR

SEQ ID NO: 6580 - protein, 8 aa, HIV-1
WGWRWGTM

SEQ ID NO: 6581 - protein, 8 aa, HIV-1
WRWGTMLL

SEQ ID NO: 6582 - protein, 8 aa, HIV-1
TMLLGMLM

SEQ ID NO: 6583 - protein, 8 aa, HIV-1
MLLGMLMI

SEQ ID NO: 6584 - protein, 8 aa, HIV-1
LLGMLMIC

SEQ ID NO: 6585 - protein, 8 aa, HIV-1
GMLMICSA

SEQ ID NO: 6586 - protein, 8 aa, HIV-1
MLMICSAT

SEQ ID NO: 6587 - protein, 8 aa, HIV-1
MICSATEK

SEQ ID NO: 6588 - protein, 8 aa, HIV-1
CSATEKLW

SEQ ID NO: 6589 - protein, 8 aa, HIV-1
SATEKLWV

SEQ ID NO: 6590 - protein, 8 aa, HIV-1
EKLWVTVY

SEQ ID NO: 6591 - protein, 8 aa, HIV-1
KLWVTVYY

SEQ ID NO: 6592 - protein, 8 aa, HIV-1
WVTVYYGV

SEQ ID NO: 6593 - protein, 8 aa, HIV-1
TVYYGVPV

SEQ ID NO: 6594 - protein, 8 aa, HIV-1
VYYGVPVW

SEQ ID NO: 6595 - protein, 8 aa, HIV-1
YYGVPVWK

SEQ ID NO: 6596 - protein, 8 aa, HIV-1
VPVWKEAT

SEQ ID NO: 6597 - protein, 8 aa, HIV-1
KEATTTLF

SEQ ID NO: 6598 - protein, 8 aa, HIV-1
TTTLFCAS

SEQ ID NO: 6599 - protein, 8 aa, HIV-1
TLFCASDA

SEQ ID NO: 6600 - protein, 8 aa, HIV-1
CASDAKAY

SEQ ID NO: 6601 - protein, 8 aa, HIV-1
YDTEVHNV

SEQ ID NO: 6602 - protein, 8 aa, HIV-1
DTEVHNVW

SEQ ID NO: 6603 - protein, 8 aa, HIV-1
EVHNVWAT

SEQ ID NO: 6604 - protein, 8 aa, HIV-1
NVWATHAC

SEQ ID NO: 6605 - protein, 8 aa, HIV-1
VWATHACV

SEQ ID NO: 6606 - protein, 8 aa, HIV-1
NPQEVVLV

SEQ ID NO: 6607 - protein, 8 aa, HIV-1
QEVVLVNV

SEQ ID NO: 6608 - protein, 8 aa, HIV-1
EVVLVNVT

SEQ ID NO: 6609 - protein, 8 aa, HIV-1
NVTENFNM

SEQ ID NO: 6610 - protein, 8 aa, HIV-1
VTENFNMW

SEQ ID NO: 6611 - protein, 8 aa, HIV-1
TENFNMWK

SEQ ID NO: 6612 - protein, 8 aa, HIV-1
NMWKNDMV

SEQ ID NO: 6613 - protein, 8 aa, HIV-1
MHEDIISL

SEQ ID NO: 6614 - protein, 8 aa, HIV-1
SLWDQSLK

SEQ ID NO: 6615 - protein, 8 aa, HIV-1
QSLKPCVK

SEQ ID NO: 6616 - protein, 8 aa, HIV-1
SLKPCVKL

SEQ ID NO: 6617 - protein, 8 aa, HIV-1
KLTPLCVS

SEQ ID NO: 6618 - protein, 8 aa, HIV-1
LTPLCVSL

SEQ ID NO: 6619 - protein, 8 aa, HIV-1
TPLCVSLK

SEQ ID NO: 6620 - protein, 8 aa, HIV-1
SLKCTDLK

SEQ ID NO: 6621 - protein, 8 aa, HIV-1
NTNSSSGR

SEQ ID NO: 6622 - protein, 8 aa, HIV-1
SGRMIMEK

SEQ ID NO: 6623 - protein, 8 aa, HIV-1
MIMEKGEI

SEQ ID NO: 6624 - protein, 8 aa, HIV-1
GEIKNCSF

SEQ ID NO: 6625 - protein, 8 aa, HIV-1
FNISTSIR

SEQ ID NO: 6626 - protein, 8 aa, HIV-1
ISTSIRGK

SEQ ID NO: 6627 - protein, 8 aa, HIV-1
STSIRGKV

SEQ ID NO: 6628 - protein, 8 aa, HIV-1
SIRGKVQK

SEQ ID NO: 6629 - protein, 8 aa, HIV-1
KVQKEYAF

SEQ ID NO: 6630 - protein, 8 aa, HIV-1
VQKEYAFF

SEQ ID NO: 6631 - protein, 8 aa, HIV-1
KEYAFFYK

SEQ ID NO: 6632 - protein, 8 aa, HIV-1
EYAFFYKL

SEQ ID NO: 6633 - protein, 8 aa, HIV-1
FFYKLDII

SEQ ID NO: 6634 - protein, 8 aa, HIV-1
YKLDIIPI

SEQ ID NO: 6635 - protein, 8 aa, HIV-1
IPIDNDTT

SEQ ID NO: 6636 - protein, 8 aa, HIV-1
LTSCNTSV

SEQ ID NO: 6637 - protein, 8 aa, HIV-1
NTSVITQA

SEQ ID NO: 6638 - protein, 8 aa, HIV-1
VITQACPK

SEQ ID NO: 6639 - protein, 8 aa, HIV-1
ITQACPKV

SEQ ID NO: 6640 - protein, 8 aa, HIV-1
FEPIPIHY

SEQ ID NO: 6641 - protein, 8 aa, HIV-1
IPIHYCAP

SEQ ID NO: 6642 - protein, 8 aa, HIV-1
HYCAPAGF

SEQ ID NO: 6643 - protein, 8 aa, HIV-1
YCAPAGFA

SEQ ID NO: 6644 - protein, 8 aa, HIV-1
CAPAGFAI

SEQ ID NO: 6645 - protein, 8 aa, HIV-1
APAGFAIL

SEQ ID NO: 6646 - protein, 8 aa, HIV-1
AILKCNNK

SEQ ID NO: 6647 - protein, 8 aa, HIV-1
GTGPCTNV

SEQ ID NO: 6648 - protein, 8 aa, HIV-1
TVQCTHGI

SEQ ID NO: 6649 - protein, 8 aa, HIV-1
VQCTHGIR

SEQ ID NO: 6650 - protein, 8 aa, HIV-1
CTHGIRPV

SEQ ID NO: 6651 - protein, 8 aa, HIV-1
GIRPVVST

SEQ ID NO: 6652 - protein, 8 aa, HIV-1
RPVVSTQL

SEQ ID NO: 6653 - protein, 8 aa, HIV-1
VVSTQLLL

SEQ ID NO: 6654 - protein, 8 aa, HIV-1
QLLLNGSL

SEQ ID NO: 6655 - protein, 8 aa, HIV-1
LLLNGSLA

SEQ ID NO: 6656 - protein, 8 aa, HIV-1
SLAEEEVV

SEQ ID NO: 6657 - protein, 8 aa, HIV-1
EEVVIRSV

SEQ ID NO: 6658 - protein, 8 aa, HIV-1
VVIRSVNF

SEQ ID NO: 6659 - protein, 8 aa, HIV-1
SVNFTDNA

SEQ ID NO: 6660 - protein, 8 aa, HIV-1
FTDNAKTI

SEQ ID NO: 6661 - protein, 8 aa, HIV-1
IVQLNTSV

SEQ ID NO: 6662 - protein, 8 aa, HIV-1
QLNTSVEI

SEQ ID NO: 6663 - protein, 8 aa, HIV-1
SVEINCTR

SEQ ID NO: 6664 - protein, 8 aa, HIV-1
RKRIRIQR

SEQ ID NO: 6665 - protein, 8 aa, HIV-1
RIQRGPGR

SEQ ID NO: 6666 - protein, 8 aa, HIV-1
RGPGRAFV

SEQ ID NO: 6667 - protein, 8 aa, HIV-1
RAFVTIGK

SEQ ID NO: 6668 - protein, 8 aa, HIV-1
QAHCNISR

SEQ ID NO: 6669 - protein, 8 aa, HIV-1
RAKWNNTL

SEQ ID NO: 6670 - protein, 8 aa, HIV-1
TLKQIASK

SEQ ID NO: 6671 - protein, 8 aa, HIV-1
KQIASKLR

SEQ ID NO: 6672 - protein, 8 aa, HIV-1
NNKTIIFK

SEQ ID NO: 6673 - protein, 8 aa, HIV-1
PEIVTHSF

SEQ ID NO: 6674 - protein, 8 aa, HIV-1
SFNCGGEF

SEQ ID NO: 6675 - protein, 8 aa, HIV-1
GEFFYCNS

SEQ ID NO: 6676 - protein, 8 aa, HIV-1
FYCNSTQL

SEQ ID NO: 6677 - protein, 8 aa, HIV-1
QLFNSTWF

SEQ ID NO: 6678 - protein, 8 aa, HIV-1
STWFNSTW

SEQ ID NO: 6679 - protein, 8 aa, HIV-1
EGSDTITL

SEQ ID NO: 6680 - protein, 8 aa, HIV-1
DTITLPCR

SEQ ID NO: 6681 - protein, 8 aa, HIV-1
TITLPCRI

SEQ ID NO: 6682 - protein, 8 aa, HIV-1
ITLPCRIK

SEQ ID NO: 6683 - protein, 8 aa, HIV-1
LPCRIKQI

SEQ ID NO: 6684 - protein, 8 aa, HIV-1
RIKQIINM

SEQ ID NO: 6685 - protein, 8 aa, HIV-1
KQIINMWQ

SEQ ID NO: 6686 - protein, 8 aa, HIV-1
QIINMWQK

SEQ ID NO: 6687 - protein, 8 aa, HIV-1
IINMWQKV

SEQ ID NO: 6688 - protein, 8 aa, HIV-1
WQKVGKAM

SEQ ID NO: 6689 - protein, 8 aa, HIV-1
KVGKAMYA

SEQ ID NO: 6690 - protein, 8 aa, HIV-1
KAMYAPPI

SEQ ID NO: 6691 - protein, 8 aa, HIV-1
APPISGQI

SEQ ID NO: 6692 - protein, 8 aa, HIV-1
QIRCSSNI

SEQ ID NO: 6693 - protein, 8 aa, HIV-1
CSSNITGL

SEQ ID NO: 6694 - protein, 8 aa, HIV-1
ITGLLLTR

SEQ ID NO: 6695 - protein, 8 aa, HIV-1
NNESEIFR

SEQ ID NO: 6696 - protein, 8 aa, HIV-1
WRSELYKY

SEQ ID NO: 6697 - protein, 8 aa, HIV-1
RSELYKYK

SEQ ID NO: 6698 - protein, 8 aa, HIV-1
ELYKYKVV

SEQ ID NO: 6699 - protein, 8 aa, HIV-1
LYKYKVVK

SEQ ID NO: 6700 - protein, 8 aa, HIV-1
KVVKIEPL

SEQ ID NO: 6701 - protein, 8 aa, HIV-1
EPLGVAPT

SEQ ID NO: 6702 - protein, 8 aa, HIV-1
GVAPTKAK

SEQ ID NO: 6703 - protein, 8 aa, HIV-1
RRVVQREK

SEQ ID NO: 6704 - protein, 8 aa, HIV-1
RVVQREKR

SEQ ID NO: 6705 - protein, 8 aa, HIV-1
REKRAVGI

SEQ ID NO: 6706 - protein, 8 aa, HIV-1
RAVGIGAL

SEQ ID NO: 6707 - protein, 8 aa, HIV-1
FLGFLGAA

SEQ ID NO: 6708 - protein, 8 aa, HIV-1
FLGAAGST

SEQ ID NO: 6709 - protein, 8 aa, HIV-1
STMGAASM

SEQ ID NO: 6710 - protein, 8 aa, HIV-1
MGAASMTL

SEQ ID NO: 6711 - protein, 8 aa, HIV-1
AASMTLTV

SEQ ID NO: 6712 - protein, 8 aa, HIV-1
SMTLTVQA

SEQ ID NO: 6713 - protein, 8 aa, HIV-1
MTLTVQAR

SEQ ID NO: 6714 - protein, 8 aa, HIV-1
TVQARQLL

SEQ ID NO: 6715 - protein, 8 aa, HIV-1
RQLLSGIV

SEQ ID NO: 6716 - protein, 8 aa, HIV-1
QLLSGIVQ

SEQ ID NO: 6717 - protein, 8 aa, HIV-1
LLSGIVQQ

SEQ ID NO: 6718 - protein, 8 aa, HIV-1
VQQQNNLL

SEQ ID NO: 6719 - protein, 8 aa, HIV-1
QQQNNLLR

SEQ ID NO: 6720 - protein, 8 aa, HIV-1
QQNNLLRA

SEQ ID NO: 6721 - protein, 8 aa, HIV-1
NLLRAIEA

SEQ ID NO: 6722 - protein, 8 aa, HIV-1
LLRAIEAQ

SEQ ID NO: 6723 - protein, 8 aa, HIV-1
AIEAQQHL

SEQ ID NO: 6724 - protein, 8 aa, HIV-1
IEAQQHLL

SEQ ID NO: 6725 - protein, 8 aa, HIV-1
AQQHLLQL

SEQ ID NO: 6726 - protein, 8 aa, HIV-1
HLLQLTVW

SEQ ID NO: 6727 - protein, 8 aa, HIV-1
LQLTVWGI

SEQ ID NO: 6728 - protein, 8 aa, HIV-1
QLTVWGIK

SEQ ID NO: 6729 - protein, 8 aa, HIV-1
TVWGIKQL

SEQ ID NO: 6730 - protein, 8 aa, HIV-1
GIKQLQAR

SEQ ID NO: 6731 - protein, 8 aa, HIV-1
KQLQARIL

SEQ ID NO: 6732 - protein, 8 aa, HIV-1
QLQARILA

SEQ ID NO: 6733 - protein, 8 aa, HIV-1
LQARILAV

SEQ ID NO: 6734 - protein, 8 aa, HIV-1
ILAVERYL

SEQ ID NO: 6735 - protein, 8 aa, HIV-1
LAVERYLK

SEQ ID NO: 6736 - protein, 8 aa, HIV-1
RYLKDQQL

SEQ ID NO: 6737 - protein, 8 aa, HIV-1
YLKDQQLL

SEQ ID NO: 6738 - protein, 8 aa, HIV-1
QLLGIWGC

SEQ ID NO: 6739 - protein, 8 aa, HIV-1
GIWGCSGK

SEQ ID NO: 6740 - protein, 8 aa, HIV-1
KLICTTAV

SEQ ID NO: 6741 - protein, 8 aa, HIV-1
TTAVPWNA

SEQ ID NO: 6742 - protein, 8 aa, HIV-1
AVPWNASW

SEQ ID NO: 6743 - protein, 8 aa, HIV-1
VPWNASWS

SEQ ID NO: 6744 - protein, 8 aa, HIV-1
QIWNHTTW

SEQ ID NO: 6745 - protein, 8 aa, HIV-1
TTWMEWDR

SEQ ID NO: 6746 - protein, 8 aa, HIV-1
WMEWDREI

SEQ ID NO: 6747 - protein, 8 aa, HIV-1
WDREINNY

SEQ ID NO: 6748 - protein, 8 aa, HIV-1
EINNYTSL

SEQ ID NO: 6749 - protein, 8 aa, HIV-1
YTSLIHSL

SEQ ID NO: 6750 - protein, 8 aa, HIV-1
ESQNQQEK

SEQ ID NO: 6751 - protein, 8 aa, HIV-1
QEKNEQEL

SEQ ID NO: 6752 - protein, 8 aa, HIV-1
NEQELLEL

SEQ ID NO: 6753 - protein, 8 aa, HIV-1
LLELDKWA

SEQ ID NO: 6754 - protein, 8 aa, HIV-1
ELDKWASL

SEQ ID NO: 6755 - protein, 8 aa, HIV-1
KWASLWNW

SEQ ID NO: 6756 - protein, 8 aa, HIV-1
WASLWNWF

SEQ ID NO: 6757 - protein, 8 aa, HIV-1
SLWNWFNI

SEQ ID NO: 6758 - protein, 8 aa, HIV-1
NWFNITNW

SEQ ID NO: 6759 - protein, 8 aa, HIV-1
WFNITNWL

SEQ ID NO: 6760 - protein, 8 aa, HIV-1
FNITNWLW

SEQ ID NO: 6761 - protein, 8 aa, HIV-1
NITNWLWY

SEQ ID NO: 6762 - protein, 8 aa, HIV-1
ITNWLWYI

SEQ ID NO: 6763 - protein, 8 aa, HIV-1
NWLWYIKL

SEQ ID NO: 6764 - protein, 8 aa, HIV-1
WLWYIKLF

SEQ ID NO: 6765 - protein, 8 aa, HIV-1
LWYIKLFI

SEQ ID NO: 6766 - protein, 8 aa, HIV-1
WYIKLFIM

SEQ ID NO: 6767 - protein, 8 aa, HIV-1
YIKLFIMI

SEQ ID NO: 6768 - protein, 8 aa, HIV-1
FIMIVGGL

SEQ ID NO: 6769 - protein, 8 aa, HIV-1
IMIVGGLV

SEQ ID NO: 6770 - protein, 8 aa, HIV-1
IVGGLVGL

SEQ ID NO: 6771 - protein, 8 aa, HIV-1
GLVGLRIV

SEQ ID NO: 6772 - protein, 8 aa, HIV-1
GLRIVFAV

SEQ ID NO: 6773 - protein, 8 aa, HIV-1
IVFAVLSI

SEQ ID NO: 6774 - protein, 8 aa, HIV-1
AVLSIVNR

SEQ ID NO: 6775 - protein, 8 aa, HIV-1
VLSIVNRV

SEQ ID NO: 6776 - protein, 8 aa, HIV-1
LSIVNRVR

SEQ ID NO: 6777 - protein, 8 aa, HIV-1
VRQGYSPL

SEQ ID NO: 6778 - protein, 8 aa, HIV-1
SPLSFQTH

SEQ ID NO: 6779 - protein, 8 aa, HIV-1
PLSFQTHL

SEQ ID NO: 6780 - protein, 8 aa, HIV-1
FQTHLPTP

SEQ ID NO: 6781 - protein, 8 aa, HIV-1
QTHLPTPR

SEQ ID NO: 6782 - protein, 8 aa, HIV-1
LPTPRGPD

SEQ ID NO: 6783 - protein, 8 aa, HIV-1
RDRDRSIR

SEQ ID NO: 6784 - protein, 8 aa, HIV-1
RLVNGSLA

SEQ ID NO: 6785 - protein, 8 aa, HIV-1
LVNGSLAL

SEQ ID NO: 6786 - protein, 8 aa, HIV-1
ALIWDDLR

SEQ ID NO: 6787 - protein, 8 aa, HIV-1
RSLCLFSY

SEQ ID NO: 6788 - protein, 8 aa, HIV-1
LCLFSYHR

SEQ ID NO: 6789 - protein, 8 aa, HIV-1
CLFSYHRL

SEQ ID NO: 6790 - protein, 8 aa, HIV-1
LFSYHRLR

SEQ ID NO: 6791 - protein, 8 aa, HIV-1
SYHRLRDL

SEQ ID NO: 6792 - protein, 8 aa, HIV-1
RLRDLLLI

SEQ ID NO: 6793 - protein, 8 aa, HIV-1
DLLLIVTR

SEQ ID NO: 6794 - protein, 8 aa, HIV-1
LLLIVTRI

SEQ ID NO: 6795 - protein, 8 aa, HIV-1
LLIVTRIV

SEQ ID NO: 6796 - protein, 8 aa, HIV-1
IVTRIVEL

SEQ ID NO: 6797 - protein, 8 aa, HIV-1
RIVELLGR

SEQ ID NO: 6798 - protein, 8 aa, HIV-1
IVELLGRR

SEQ ID NO: 6799 - protein, 8 aa, HIV-1
GRRGWEAL

SEQ ID NO: 6800 - protein, 8 aa, HIV-1
RRGWEALK

SEQ ID NO: 6801 - protein, 8 aa, HIV-1
WEALKYWW

SEQ ID NO: 6802 - protein, 8 aa, HIV-1
ALKYWWNL

SEQ ID NO: 6803 - protein, 8 aa, HIV-1
YWWNLLQY

SEQ ID NO: 6804 - protein, 8 aa, HIV-1
NLLQYWSQ

SEQ ID NO: 6805 - protein, 8 aa, HIV-1
LQYWSQEL

SEQ ID NO: 6806 - protein, 8 aa, HIV-1
QYWSQELK

SEQ ID NO: 6807 - protein, 8 aa, HIV-1
SLLNATAI

SEQ ID NO: 6808 - protein, 8 aa, HIV-1
LLNATAIA

SEQ ID NO: 6809 - protein, 8 aa, HIV-1
NATAIAVA

SEQ ID NO: 6810 - protein, 8 aa, HIV-1
AVAEGTDR

SEQ ID NO: 6811 - protein, 8 aa, HIV-1
AEGTDRVI

SEQ ID NO: 6812 - protein, 8 aa, HIV-1
GTDRVIEV

SEQ ID NO: 6813 - protein, 8 aa, HIV-1
EVVQGACR

SEQ ID NO: 6814 - protein, 8 aa, HIV-1
RAIRHIPR

SEQ ID NO: 6815 - protein, 8 aa, HIV-1
AIRHIPRR

SEQ ID NO: 6816 - protein, 8 aa, HIV-1
RHIPRRIR

SEQ ID NO: 6817 - protein, 8 aa, HIV-1
IPRRIRQG

SEQ ID NO: 6818 - protein, 8 aa, HIV-1
RIRQGLER

SEQ ID NO: 6819 - protein, 9 aa, HIV-1
RVKEKYQHL

SEQ ID NO: 6820 - protein, 9 aa, HIV-1
KEKYQHLWR

SEQ ID NO: 6821 - protein, 9 aa, HIV-1
YQHLWRWGW

SEQ ID NO: 6822 - protein, 9 aa, HIV-1
HLWRWGWRW

SEQ ID NO: 6823 - protein, 9 aa, HIV-1
WRWGWRWGT

SEQ ID NO: 6824 - protein, 9 aa, HIV-1
WGWRWGTML

SEQ ID NO: 6825 - protein, 9 aa, HIV-1
GWRWGTMLL

SEQ ID NO: 6826 - protein, 9 aa, HIV-1
TMLLGMLMI

SEQ ID NO: 6827 - protein, 9 aa, HIV-1
MLLGMLMIC

SEQ ID NO: 6828 - protein, 9 aa, HIV-1
LGMLMICSA

SEQ ID NO: 6829 - protein, 9 aa, HIV-1
LMICSATEK

SEQ ID NO: 6830 - protein, 9 aa, HIV-1
MICSATEKL

SEQ ID NO: 6831 - protein, 9 aa, HIV-1
ICSATEKLW

SEQ ID NO: 6832 - protein, 9 aa, HIV-1
ATEKLWVTV

SEQ ID NO: 6833 - protein, 9 aa, HIV-1
TEKLWVTVY

SEQ ID NO: 6834 - protein, 9 aa, HIV-1
EKLWVTVYY

SEQ ID NO: 6835 - protein, 9 aa, HIV-1
KLWVTVYYG

SEQ ID NO: 6836 - protein, 9 aa, HIV-1
LWVTVYYGV

SEQ ID NO: 6837 - protein, 9 aa, HIV-1
VTVYYGVPV

SEQ ID NO: 6838 - protein, 9 aa, HIV-1
TVYYGVPVW

SEQ ID NO: 6839 - protein, 9 aa, HIV-1
VYYGVPVWK

SEQ ID NO: 6840 - protein, 9 aa, HIV-1
VPVWKEATT

SEQ ID NO: 6841 - protein, 9 aa, HIV-1
VWKEATTTL

SEQ ID NO: 6842 - protein, 9 aa, HIV-1
EATTTLFCA

SEQ ID NO: 6843 - protein, 9 aa, HIV-1
TLFCASDAK

SEQ ID NO: 6844 - protein, 9 aa, HIV-1
FCASDAKAY

SEQ ID NO: 6845 - protein, 9 aa, HIV-1
AYDTEVHNV

SEQ ID NO: 6846 - protein, 9 aa, HIV-1
TEVHNVWAT

SEQ ID NO: 6847 - protein, 9 aa, HIV-1
EVHNVWATH

SEQ ID NO: 6848 - protein, 9 aa, HIV-1
NVWATHACV

SEQ ID NO: 6849 - protein, 9 aa, HIV-1
PTDPNPQEV

SEQ ID NO: 6850 - protein, 9 aa, HIV-1
DPNPQEVVL

SEQ ID NO: 6851 - protein, 9 aa, HIV-1
VLVNVTENF

SEQ ID NO: 6852 - protein, 9 aa, HIV-1
VTENFNMWK

SEQ ID NO: 6853 - protein, 9 aa, HIV-1
FNMWKNDMV

SEQ ID NO: 6854 - protein, 9 aa, HIV-1
QMHEDIISL

SEQ ID NO: 6855 - protein, 9 aa, HIV-1
IISLWDQSL

SEQ ID NO: 6856 - protein, 9 aa, HIV-1
ISLWDQSLK

SEQ ID NO: 6857 - protein, 9 aa, HIV-1
SLWDQSLKP

SEQ ID NO: 6858 - protein, 9 aa, HIV-1
SLKPCVKLT

SEQ ID NO: 6859 - protein, 9 aa, HIV-1
KPCVKLTPL

SEQ ID NO: 6860 - protein, 9 aa, HIV-1
KLTPLCVSL

SEQ ID NO: 6861 - protein, 9 aa, HIV-1
LTPLCVSLK

SEQ ID NO: 6862 - protein, 9 aa, HIV-1
VSLKCTDLK

SEQ ID NO: 6863 - protein, 9 aa, HIV-1
TNTNSSSGR

SEQ ID NO: 6864 - protein, 9 aa, HIV-1
NTNSSSGRM

SEQ ID NO: 6865 - protein, 9 aa, HIV-1
SSGRMIMEK

SEQ ID NO: 6866 - protein, 9 aa, HIV-1
RMIMEKGEI

SEQ ID NO: 6867 - protein, 9 aa, HIV-1
MIMEKGEIK

SEQ ID NO: 6868 - protein, 9 aa, HIV-1
EIKNCSFNI

SEQ ID NO: 6869 - protein, 9 aa, HIV-1
CSFNISTSI

SEQ ID NO: 6870 - protein, 9 aa, HIV-1
SFNISTSIR

SEQ ID NO: 6871 - protein, 9 aa, HIV-1
NISTSIRGK

SEQ ID NO: 6872 - protein, 9 aa, HIV-1
ISTSIRGKV

SEQ ID NO: 6873 - protein, 9 aa, HIV-1
TSIRGKVQK

SEQ ID NO: 6874 - protein, 9 aa, HIV-1
KVQKEYAFF

SEQ ID NO: 6875 - protein, 9 aa, HIV-1
VQKEYAFFY

SEQ ID NO: 6876 - protein, 9 aa, HIV-1
KEYAFFYKL

SEQ ID NO: 6877 - protein, 9 aa, HIV-1
AFFYKLDII

SEQ ID NO: 6878 - protein, 9 aa, HIV-1
FYKLDIIPI

SEQ ID NO: 6879 - protein, 9 aa, HIV-1
IPIDNDTTS

SEQ ID NO: 6880 - protein, 9 aa, HIV-1
PIDNDTTSY

SEQ ID NO: 6881 - protein, 9 aa, HIV-1
KLTSCNTSV

SEQ ID NO: 6882 - protein, 9 aa, HIV-1
LTSCNTSVI

SEQ ID NO: 6883 - protein, 9 aa, HIV-1
NTSVITQAC

SEQ ID NO: 6884 - protein, 9 aa, HIV-1
SVITQACPK

SEQ ID NO: 6885 - protein, 9 aa, HIV-1
VITQACPKV

SEQ ID NO: 6886 - protein, 9 aa, HIV-1
TQACPKVSF

SEQ ID NO: 6887 - protein, 9 aa, HIV-1
CPKVSFEPI

SEQ ID NO: 6888 - protein, 9 aa, HIV-1
KVSFEPIPI

SEQ ID NO: 6889 - protein, 9 aa, HIV-1
SFEPIPIHY

SEQ ID NO: 6890 - protein, 9 aa, HIV-1
EPIPIHYCA

SEQ ID NO: 6891 - protein, 9 aa, HIV-1
IPIHYCAPA

SEQ ID NO: 6892 - protein, 9 aa, HIV-1
YCAPAGFAI

SEQ ID NO: 6893 - protein, 9 aa, HIV-1
CAPAGFAIL

SEQ ID NO: 6894 - protein, 9 aa, HIV-1
APAGFAILK

SEQ ID NO: 6895 - protein, 9 aa, HIV-1
FAILKCNNK

SEQ ID NO: 6896 - protein, 9 aa, HIV-1
ILKCNNKTF

SEQ ID NO: 6897 - protein, 9 aa, HIV-1
NGTGPCTNV

SEQ ID NO: 6898 - protein, 9 aa, HIV-1
STVQCTHGI

SEQ ID NO: 6899 - protein, 9 aa, HIV-1
TVQCTHGIR

SEQ ID NO: 6900 - protein, 9 aa, HIV-1
CTHGIRPVV

SEQ ID NO: 6901 - protein, 9 aa, HIV-1
RPVVSTQLL

SEQ ID NO: 6902 - protein, 9 aa, HIV-1
TQLLLNGSL

SEQ ID NO: 6903 - protein, 9 aa, HIV-1
QLLLNGSLA

SEQ ID NO: 6904 - protein, 9 aa, HIV-1
LLLNGSLAE

SEQ ID NO: 6905 - protein, 9 aa, HIV-1
LLNGSLAEE

SEQ ID NO: 6906 - protein, 9 aa, HIV-1
SLAEEEVVI

SEQ ID NO: 6907 - protein, 9 aa, HIV-1
EVVIRSVNF

SEQ ID NO: 6908 - protein, 9 aa, HIV-1
SVNFTDNAK

SEQ ID NO: 6909 - protein, 9 aa, HIV-1
NAKTIIVQL

SEQ ID NO: 6910 - protein, 9 aa, HIV-1
IIVQLNTSV

SEQ ID NO: 6911 - protein, 9 aa, HIV-1
VQLNTSVEI

SEQ ID NO: 6912 - protein, 9 aa, HIV-1
TSVEINCTR

SEQ ID NO: 6913 - protein, 9 aa, HIV-1
CTRPNNNTR

SEQ ID NO: 6914 - protein, 9 aa, HIV-1
RPNNNTRKR

SEQ ID NO: 6915 - protein, 9 aa, HIV-1
IQRGPGRAF

SEQ ID NO: 6916 - protein, 9 aa, HIV-1
QRGPGRAFV

SEQ ID NO: 6917 - protein, 9 aa, HIV-1
GPGRAFVTI

SEQ ID NO: 6918 - protein, 9 aa, HIV-1
GRAFVTIGK

SEQ ID NO: 6919 - protein, 9 aa, HIV-1
VTIGKIGNM

SEQ ID NO: 6920 - protein, 9 aa, HIV-1
TIGKIGNMR

SEQ ID NO: 6921 - protein, 9 aa, HIV-1
NMRQAHCNI

SEQ ID NO: 6922 - protein, 9 aa, HIV-1
RQAHCNISR

SEQ ID NO: 6923 - protein, 9 aa, HIV-1
QAHCNISRA

SEQ ID NO: 6924 - protein, 9 aa, HIV-1
HCNISRAKW

SEQ ID NO: 6925 - protein, 9 aa, HIV-1
SRAKWNNTL

SEQ ID NO: 6926 - protein, 9 aa, HIV-1
RAKWNNTLK

SEQ ID NO: 6927 - protein, 9 aa, HIV-1
NTLKQIASK

SEQ ID NO: 6928 - protein, 9 aa, HIV-1
TLKQIASKL

SEQ ID NO: 6929 - protein, 9 aa, HIV-1
IASKLREQF

SEQ ID NO: 6930 - protein, 9 aa, HIV-1
GNNKTIIFK

SEQ ID NO: 6931 - protein, 9 aa, HIV-1
KQSSGGDPE

SEQ ID NO: 6932 - protein, 9 aa, HIV-1
DPEIVTHSF

SEQ ID NO: 6933 - protein, 9 aa, HIV-1
HSFNCGGEF

SEQ ID NO: 6934 - protein, 9 aa, HIV-1
SFNCGGEFF

SEQ ID NO: 6935 - protein, 9 aa, HIV-1
FNCGGEFFY

SEQ ID NO: 6936 - protein, 9 aa, HIV-1
GEFFYCNST

SEQ ID NO: 6937 - protein, 9 aa, HIV-1
FFYCNSTQL

SEQ ID NO: 6938 - protein, 9 aa, HIV-1
FYCNSTQLF

SEQ ID NO: 6939 - protein, 9 aa, HIV-1
STQLFNSTW

SEQ ID NO: 6940 - protein, 9 aa, HIV-1
TQLFNSTWF

SEQ ID NO: 6941 - protein, 9 aa, HIV-1
QLFNSTWFN

SEQ ID NO: 6942 - protein, 9 aa, HIV-1
NSTWFNSTW

SEQ ID NO: 6943 - protein, 9 aa, HIV-1
TEGSDTITL

SEQ ID NO: 6944 - protein, 9 aa, HIV-1
DTITLPCRI

SEQ ID NO: 6945 - protein, 9 aa, HIV-1
TITLPCRIK

SEQ ID NO: 6946 - protein, 9 aa, HIV-1
TLPCRIKQI

SEQ ID NO: 6947 - protein, 9 aa, HIV-1
LPCRIKQII

SEQ ID NO: 6948 - protein, 9 aa, HIV-1
KQIINMWQK

SEQ ID NO: 6949 - protein, 9 aa, HIV-1
QIINMWQKV

SEQ ID NO: 6950 - protein, 9 aa, HIV-1
NMWQKVGKA

SEQ ID NO: 6951 - protein, 9 aa, HIV-1
MWQKVGKAM

SEQ ID NO: 6952 - protein, 9 aa, HIV-1
WQKVGKAMY

SEQ ID NO: 6953 - protein, 9 aa, HIV-1
YAPPISGQI

SEQ ID NO: 6954 - protein, 9 aa, HIV-1
GQIRCSSNI

SEQ ID NO: 6955 - protein, 9 aa, HIV-1
RCSSNITGL

SEQ ID NO: 6956 - protein, 9 aa, HIV-1
CSSNITGLL

SEQ ID NO: 6957 - protein, 9 aa, HIV-1
NITGLLLTR

SEQ ID NO: 6958 - protein, 9 aa, HIV-1
NSNNESEIF

SEQ ID NO: 6959 - protein, 9 aa, HIV-1
SNNESEIFR

SEQ ID NO: 6960 - protein, 9 aa, HIV-1
MRDNWRSEL

SEQ ID NO: 6961 - protein, 9 aa, HIV-1
NWRSELYKY

SEQ ID NO: 6962 - protein, 9 aa, HIV-1
WRSELYKYK

SEQ ID NO: 6963 - protein, 9 aa, HIV-1
ELYKYKVVK

SEQ ID NO: 6964 - protein, 9 aa, HIV-1
LYKYKVVKI

SEQ ID NO: 6965 - protein, 9 aa, HIV-1
VVKIEPLGV

SEQ ID NO: 6966 - protein, 9 aa, HIV-1
EPLGVAPTK

SEQ ID NO: 6967 - protein, 9 aa, HIV-1
GVAPTKAKR

SEQ ID NO: 6968 - protein, 9 aa, HIV-1
APTKAKRRV

SEQ ID NO: 6969 - protein, 9 aa, HIV-1
KAKRRVVQR

SEQ ID NO: 6970 - protein, 9 aa, HIV-1
KRRVVQREK

SEQ ID NO: 6971 - protein, 9 aa, HIV-1
RRVVQREKR

SEQ ID NO: 6972 - protein, 9 aa, HIV-1
VVQREKRAV

SEQ ID NO: 6973 - protein, 9 aa, HIV-1
RAVGIGALF

SEQ ID NO: 6974 - protein, 9 aa, HIV-1
AVGIGALFL

SEQ ID NO: 6975 - protein, 9 aa, HIV-1
IGALFLGFL

SEQ ID NO: 6976 - protein, 9 aa, HIV-1
ALFLGFLGA

SEQ ID NO: 6977 - protein, 9 aa, HIV-1
FLGAAGSTM

SEQ ID NO: 6978 - protein, 9 aa, HIV-1
GAAGSTMGA

SEQ ID NO: 6979 - protein, 9 aa, HIV-1
STMGAASMT

SEQ ID NO: 6980 - protein, 9 aa, HIV-1
TMGAASMTL

SEQ ID NO: 6981 - protein, 9 aa, HIV-1
MGAASMTLT

SEQ ID NO: 6982 - protein, 9 aa, HIV-1
GAASMTLTV

SEQ ID NO: 6983 - protein, 9 aa, HIV-1
SMTLTVQAR

SEQ ID NO: 6984 - protein, 9 aa, HIV-1
TLTVQARQL

SEQ ID NO: 6985 - protein, 9 aa, HIV-1
LTVQARQLL

SEQ ID NO: 6986 - protein, 9 aa, HIV-1
QARQLLSGI

SEQ ID NO: 6987 - protein, 9 aa, HIV-1
QLLSGIVQQ

SEQ ID NO: 6988 - protein, 9 aa, HIV-1
LLSGIVQQQ

SEQ ID NO: 6989 - protein, 9 aa, HIV-1
GIVQQQNNL

SEQ ID NO: 6990 - protein, 9 aa, HIV-1
VQQQNNLLR

SEQ ID NO: 6991 - protein, 9 aa, HIV-1
QQQNNLLRA

SEQ ID NO: 6992 - protein, 9 aa, HIV-1
QQNNLLRAI

SEQ ID NO: 6993 - protein, 9 aa, HIV-1
NLLRAIEAQ

SEQ ID NO: 6994 - protein, 9 aa, HIV-1
RAIEAQQHL

SEQ ID NO: 6995 - protein, 9 aa, HIV-1
AIEAQQHLL

SEQ ID NO: 6996 - protein, 9 aa, HIV-1
EAQQHLLQL

SEQ ID NO: 6997 - protein, 9 aa, HIV-1
AQQHLLQLT

SEQ ID NO: 6998 - protein, 9 aa, HIV-1
QQHLLQLTV

SEQ ID NO: 6999 - protein, 9 aa, HIV-1
HLLQLTVWG

SEQ ID NO: 7000 - protein, 9 aa, HIV-1
LLQLTVWGI

SEQ ID NO: 7001 - protein, 9 aa, HIV-1
LQLTVWGIK

SEQ ID NO: 7002 - protein, 9 aa, HIV-1
LTVWGIKQL

SEQ ID NO: 7003 - protein, 9 aa, HIV-1
TVWGIKQLQ

SEQ ID NO: 7004 - protein, 9 aa, HIV-1
GIKQLQARI

SEQ ID NO: 7005 - protein, 9 aa, HIV-1
KQLQARILA

SEQ ID NO: 7006 - protein, 9 aa, HIV-1
QLQARILAV

SEQ ID NO: 7007 - protein, 9 aa, HIV-1
QARILAVER

SEQ ID NO: 7008 - protein, 9 aa, HIV-1
RILAVERYL

SEQ ID NO: 7009 - protein, 9 aa, HIV-1
ILAVERYLK

SEQ ID NO: 7010 - protein, 9 aa, HIV-1
RYLKDQQLL

SEQ ID NO: 7011 - protein, 9 aa, HIV-1
YLKDQQLLG

SEQ ID NO: 7012 - protein, 9 aa, HIV-1
QQLLGIWGC

SEQ ID NO: 7013 - protein, 9 aa, HIV-1
GIWGCSGKL

SEQ ID NO: 7014 - protein, 9 aa, HIV-1
IWGCSGKLI

SEQ ID NO: 7015 - protein, 9 aa, HIV-1
CTTAVPWNA

SEQ ID NO: 7016 - protein, 9 aa, HIV-1
TTAVPWNAS

SEQ ID NO: 7017 - protein, 9 aa, HIV-1
TAVPWNASW

SEQ ID NO: 7018 - protein, 9 aa, HIV-1
VPWNASWSN

SEQ ID NO: 7019 - protein, 9 aa, HIV-1
KSLEQIWNH

SEQ ID NO: 7020 - protein, 9 aa, HIV-1
QIWNHTTWM

SEQ ID NO: 7021 - protein, 9 aa, HIV-1
HTTWMEWDR

SEQ ID NO: 7022 - protein, 9 aa, HIV-1
TWMEWDREI

SEQ ID NO: 7023 - protein, 9 aa, HIV-1
REINNYTSL

SEQ ID NO: 7024 - protein, 9 aa, HIV-1
EINNYTSLI

SEQ ID NO: 7025 - protein, 9 aa, HIV-1
NYTSLIHSL

SEQ ID NO: 7026 - protein, 9 aa, HIV-1
YTSLIHSLI

SEQ ID NO: 7027 - protein, 9 aa, HIV-1
SLIEESQNQ

SEQ ID NO: 7028 - protein, 9 aa, HIV-1
QEKNEQELL

SEQ ID NO: 7029 - protein, 9 aa, HIV-1
ELLELDKWA

SEQ ID NO: 7030 - protein, 9 aa, HIV-1
LELDKWASL

SEQ ID NO: 7031 - protein, 9 aa, HIV-1
KWASLWNWF

SEQ ID NO: 7032 - protein, 9 aa, HIV-1
SLWNWFNIT

SEQ ID NO: 7033 - protein, 9 aa, HIV-1
NWFNITNWL

SEQ ID NO: 7034 - protein, 9 aa, HIV-1
WFNITNWLW

SEQ ID NO: 7035 - protein, 9 aa, HIV-1
FNITNWLWY

SEQ ID NO: 7036 - protein, 9 aa, HIV-1
NITNWLWYI

SEQ ID NO: 7037 - protein, 9 aa, HIV-1
ITNWLWYIK

SEQ ID NO: 7038 - protein, 9 aa, HIV-1
NWLWYIKLF

SEQ ID NO: 7039 - protein, 9 aa, HIV-1
WLWYIKLFI

SEQ ID NO: 7040 - protein, 9 aa, HIV-1
WYIKLFIMI

SEQ ID NO: 7041 - protein, 9 aa, HIV-1
YIKLFIMIV

SEQ ID NO: 7042 - protein, 9 aa, HIV-1
FIMIVGGLV

SEQ ID NO: 7043 - protein, 9 aa, HIV-1
MIVGGLVGL

SEQ ID NO: 7044 - protein, 9 aa, HIV-1
IVGGLVGLR

SEQ ID NO: 7045 - protein, 9 aa, HIV-1
GLVGLRIVF

SEQ ID NO: 7046 - protein, 9 aa, HIV-1
LVGLRIVFA

SEQ ID NO: 7047 - protein, 9 aa, HIV-1
VGLRIVFAV

SEQ ID NO: 7048 - protein, 9 aa, HIV-1
GLRIVFAVL

SEQ ID NO: 7049 - protein, 9 aa, HIV-1
RIVFAVLSI

SEQ ID NO: 7050 - protein, 9 aa, HIV-1
IVFAVLSIV

SEQ ID NO: 7051 - protein, 9 aa, HIV-1
FAVLSIVNR

SEQ ID NO: 7052 - protein, 9 aa, HIV-1
AVLSIVNRV

SEQ ID NO: 7053 - protein, 9 aa, HIV-1
VLSIVNRVR

SEQ ID NO: 7054 - protein, 9 aa, HIV-1
IVNRVRQGY

SEQ ID NO: 7055 - protein, 9 aa, HIV-1
RVRQGYSPL

SEQ ID NO: 7056 - protein, 9 aa, HIV-1
RQGYSPLSF

SEQ ID NO: 7057 - protein, 9 aa, HIV-1
SPLSFQTHL

SEQ ID NO: 7058 - protein, 9 aa, HIV-1
FQTHLPTPR

SEQ ID NO: 7059 - protein, 9 aa, HIV-1
RDRDRSIRL

SEQ ID NO: 7060 - protein, 9 aa, HIV-1
SIRLVNGSL

SEQ ID NO: 7061 - protein, 9 aa, HIV-1
RLVNGSLAL

SEQ ID NO: 7062 - protein, 9 aa, HIV-1
LVNGSLALI

SEQ ID NO: 7063 - protein, 9 aa, HIV-1
SLALIWDDL

SEQ ID NO: 7064 - protein, 9 aa, HIV-1
LALIWDDLR

SEQ ID NO: 7065 - protein, 9 aa, HIV-1
LIWDDLRSL

SEQ ID NO: 7066 - protein, 9 aa, HIV-1
RSLCLFSYH

SEQ ID NO: 7067 - protein, 9 aa, HIV-1
SLCLFSYHR

SEQ ID NO: 7068 - protein, 9 aa, HIV-1
CLFSYHRLR

SEQ ID NO: 7069 - protein, 9 aa, HIV-1
SYHRLRDLL

SEQ ID NO: 7070 - protein, 9 aa, HIV-1
YHRLRDLLL

SEQ ID NO: 7071 - protein, 9 aa, HIV-1
RLRDLLLIV

SEQ ID NO: 7072 - protein, 9 aa, HIV-1
RDLLLIVTR

SEQ ID NO: 7073 - protein, 9 aa, HIV-1
DLLLIVTRI

SEQ ID NO: 7074 - protein, 9 aa, HIV-1
LLLIVTRIV

SEQ ID NO: 7075 - protein, 9 aa, HIV-1
LIVTRIVEL

SEQ ID NO: 7076 - protein, 9 aa, HIV-1
IVTRIVELL

SEQ ID NO: 7077 - protein, 9 aa, HIV-1
RIVELLGRR

SEQ ID NO: 7078 - protein, 9 aa, HIV-1
VELLGRRGW

SEQ ID NO: 7079 - protein, 9 aa, HIV-1
LLGRRGWEA

SEQ ID NO: 7080 - protein, 9 aa, HIV-1
GRRGWEALK

SEQ ID NO: 7081 - protein, 9 aa, HIV-1
RRGWEALKY

SEQ ID NO: 7082 - protein, 9 aa, HIV-1
RGWEALKYW

SEQ ID NO: 7083 - protein, 9 aa, HIV-1
EALKYWWNL

SEQ ID NO: 7084 - protein, 9 aa, HIV-1
ALKYWWNLL

SEQ ID NO: 7085 - protein, 9 aa, HIV-1
KYWWNLLQY

SEQ ID NO: 7086 - protein, 9 aa, HIV-1
YWWNLLQYW

SEQ ID NO: 7087 - protein, 9 aa, HIV-1
LLQYWSQEL

SEQ ID NO: 7088 - protein, 9 aa, HIV-1
LQYWSQELK

SEQ ID NO: 7089 - protein, 9 aa, HIV-1
SQELKNSAV

SEQ ID NO: 7090 - protein, 9 aa, HIV-1
ELKNSAVSL

SEQ ID NO: 7091 - protein, 9 aa, HIV-1
LKNSAVSLL

SEQ ID NO: 7092 - protein, 9 aa, HIV-1
SAVSLLNAT

SEQ ID NO: 7093 - protein, 9 aa, HIV-1
SLLNATAIA

SEQ ID NO: 7094 - protein, 9 aa, HIV-1
LLNATAIAV

SEQ ID NO: 7095 - protein, 9 aa, HIV-1
TAIAVAEGT

SEQ ID NO: 7096 - protein, 9 aa, HIV-1
IAVAEGTDR

SEQ ID NO: 7097 - protein, 9 aa, HIV-1
AVAEGTDRV

SEQ ID NO: 7098 - protein, 9 aa, HIV-1
EGTDRVIEV

SEQ ID NO: 7099 - protein, 9 aa, HIV-1
GTDRVIEVV

SEQ ID NO: 7100 - protein, 9 aa, HIV-1
RVIEVVQGA

SEQ ID NO: 7101 - protein, 9 aa, HIV-1
EVVQGACRA

SEQ ID NO: 7102 - protein, 9 aa, HIV-1
VQGACRAIR

SEQ ID NO: 7103 - protein, 9 aa, HIV-1
RAIRHIPRR

SEQ ID NO: 7104 - protein, 9 aa, HIV-1
AIRHIPRRI

SEQ ID NO: 7105 - protein, 9 aa, HIV-1
IPRRIRQGL

SEQ ID NO: 7106 - protein, 9 aa, HIV-1
RRIRQGLER

SEQ ID NO: 7107 - protein, 9 aa, HIV-1
RIRQGLERI

SEQ ID NO: 7108 - protein, 9 aa, HIV-1
RQGLERILL

SEQ ID NO: 7109 - protein, 10 aa, HIV-1
RVKEKYQHLW

SEQ ID NO: 7110 - protein, 10 aa, HIV-1
KEKYQHLWRW

SEQ ID NO: 7111 - protein, 10 aa, HIV-1
KYQHLWRWGW

SEQ ID NO: 7112 - protein, 10 aa, HIV-1
YQHLWRWGWR

SEQ ID NO: 7113 - protein, 10 aa, HIV-1
HLWRWGWRWG

SEQ ID NO: 7114 - protein, 10 aa, HIV-1
WRWGWRWGTM

SEQ ID NO: 7115 - protein, 10 aa, HIV-1
RWGWRWGTML

SEQ ID NO: 7116 - protein, 10 aa, HIV-1
WGWRWGTMLL

SEQ ID NO: 7117 - protein, 10 aa, HIV-1
WRWGTMLLGM

SEQ ID NO: 7118 - protein, 10 aa, HIV-1
RWGTMLLGML

SEQ ID NO: 7119 - protein, 10 aa, HIV-1
TMLLGMLMIC

SEQ ID NO: 7120 - protein, 10 aa, HIV-1
MLLGMLMICS

SEQ ID NO: 7121 - protein, 10 aa, HIV-1
LLGMLMICSA

SEQ ID NO: 7122 - protein, 10 aa, HIV-1
MLMICSATEK

SEQ ID NO: 7123 - protein, 10 aa, HIV-1
LMICSATEKL

SEQ ID NO: 7124 - protein, 10 aa, HIV-1
SATEKLWVTV

SEQ ID NO: 7125 - protein, 10 aa, HIV-1
ATEKLWVTVY

SEQ ID NO: 7126 - protein, 10 aa, HIV-1
TEKLWVTVYY

SEQ ID NO: 7127 - protein, 10 aa, HIV-1
KLWVTVYYGV

SEQ ID NO: 7128 - protein, 10 aa, HIV-1
WVTVYYGVPV

SEQ ID NO: 7129 - protein, 10 aa, HIV-1
VTVYYGVPVW

SEQ ID NO: 7130 - protein, 10 aa, HIV-1
TVYYGVPVWK

SEQ ID NO: 7131 - protein, 10 aa, HIV-1
VPVWKEATTT

SEQ ID NO: 7132 - protein, 10 aa, HIV-1
PVWKEATTTL

SEQ ID NO: 7133 - protein, 10 aa, HIV-1
VWKEATTTLF

SEQ ID NO: 7134 - protein, 10 aa, HIV-1
TTTLFCASDA

SEQ ID NO: 7135 - protein, 10 aa, HIV-1
TTLFCASDAK

SEQ ID NO: 7136 - protein, 10 aa, HIV-1
TLFCASDAKA

SEQ ID NO: 7137 - protein, 10 aa, HIV-1
LFCASDAKAY

SEQ ID NO: 7138 - protein, 10 aa, HIV-1
KAYDTEVHNV

SEQ ID NO: 7139 - protein, 10 aa, HIV-1
AYDTEVHNVW

SEQ ID NO: 7140 - protein, 10 aa, HIV-1
EVHNVWATHA

SEQ ID NO: 7141 - protein, 10 aa, HIV-1
HNVWATHACV

SEQ ID NO: 7142 - protein, 10 aa, HIV-1
PTDPNPQEVV

SEQ ID NO: 7143 - protein, 10 aa, HIV-1
DPNPQEVVLV

SEQ ID NO: 7144 - protein, 10 aa, HIV-1
NPQEVVLVNV

SEQ ID NO: 7145 - protein, 10 aa, HIV-1
VVLVNVTENF

SEQ ID NO: 7146 - protein, 10 aa, HIV-1
NVTENFNMWK

SEQ ID NO: 7147 - protein, 10 aa, HIV-1
NMWKNDMVEQ

SEQ ID NO: 7148 - protein, 10 aa, HIV-1
EQMHEDIISL

SEQ ID NO: 7149 - protein, 10 aa, HIV-1
DIISLWDQSL

SEQ ID NO: 7150 - protein, 10 aa, HIV-1
IISLWDQSLK

SEQ ID NO: 7151 - protein, 10 aa, HIV-1
SLWDQSLKPC

SEQ ID NO: 7152 - protein, 10 aa, HIV-1
KLTPLCVSLK

SEQ ID NO: 7153 - protein, 10 aa, HIV-1
CVSLKCTDLK

SEQ ID NO: 7154 - protein, 10 aa, HIV-1
DTNTNSSSGR

SEQ ID NO: 7155 - protein, 10 aa, HIV-1
NTNSSSGRMI

SEQ ID NO: 7156 - protein, 10 aa, HIV-1
SSSGRMIMEK

SEQ ID NO: 7157 - protein, 10 aa, HIV-1
RMIMEKGEIK

SEQ ID NO: 7158 - protein, 10 aa, HIV-1
GEIKNCSFNI

SEQ ID NO: 7159 - protein, 10 aa, HIV-1
NCSFNISTSI

SEQ ID NO: 7160 - protein, 10 aa, HIV-1
CSFNISTSIR

SEQ ID NO: 7161 - protein, 10 aa, HIV-1
NISTSIRGKV

SEQ ID NO: 7162 - protein, 10 aa, HIV-1
STSIRGKVQK

SEQ ID NO: 7163 - protein, 10 aa, HIV-1
SIRGKVQKEY

SEQ ID NO: 7164 - protein, 10 aa, HIV-1
RGKVQKEYAF

SEQ ID NO: 7165 - protein, 10 aa, HIV-1
KVQKEYAFFY

SEQ ID NO: 7166 - protein, 10 aa, HIV-1
VQKEYAFFYK

SEQ ID NO: 7167 - protein, 10 aa, HIV-1
EYAFFYKLDI

SEQ ID NO: 7168 - protein, 10 aa, HIV-1
FFYKLDIIPI

SEQ ID NO: 7169 - protein, 10 aa, HIV-1
IPIDNDTTSY

SEQ ID NO: 7170 - protein, 10 aa, HIV-1
YKLTSCNTSV

SEQ ID NO: 7171 - protein, 10 aa, HIV-1
KLTSCNTSVI

SEQ ID NO: 7172 - protein, 10 aa, HIV-1
TSVITQACPK

SEQ ID NO: 7173 - protein, 10 aa, HIV-1
SVITQACPKV

SEQ ID NO: 7174 - protein, 10 aa, HIV-1
ITQACPKVSF

SEQ ID NO: 7175 - protein, 10 aa, HIV-1
VSFEPIPIHY

SEQ ID NO: 7176 - protein, 10 aa, HIV-1
EPIPIHYCAP

SEQ ID NO: 7177 - protein, 10 aa, HIV-1
IPIHYCAPAG

SEQ ID NO: 7178 - protein, 10 aa, HIV-1
HYCAPAGFAI

SEQ ID NO: 7179 - protein, 10 aa, HIV-1
YCAPAGFAIL

SEQ ID NO: 7180 - protein, 10 aa, HIV-1
CAPAGFAILK

SEQ ID NO: 7181 - protein, 10 aa, HIV-1
FAILKCNNKT

SEQ ID NO: 7182 - protein, 10 aa, HIV-1
AILKCNNKTF

SEQ ID NO: 7183 - protein, 10 aa, HIV-1
TGPCTNVSTV

SEQ ID NO: 7184 - protein, 10 aa, HIV-1
STVQCTHGIR

SEQ ID NO: 7185 - protein, 10 aa, HIV-1
VQCTHGIRPV

SEQ ID NO: 7186 - protein, 10 aa, HIV-1
GIRPVVSTQL

SEQ ID NO: 7187 - protein, 10 aa, HIV-1
RPVVSTQLLL

SEQ ID NO: 7188 - protein, 10 aa, HIV-1
STQLLLNGSL

SEQ ID NO: 7189 - protein, 10 aa, HIV-1
TQLLLNGSLA

SEQ ID NO: 7190 - protein, 10 aa, HIV-1
LLLNGSLAEE

SEQ ID NO: 7191 - protein, 10 aa, HIV-1
LNGSLAEEEV

SEQ ID NO: 7192 - protein, 10 aa, HIV-1
SLAEEEVVIR

SEQ ID NO: 7193 - protein, 10 aa, HIV-1
AEEEVVIRSV

SEQ ID NO: 7194 - protein, 10 aa, HIV-1
EEVVIRSVNF

SEQ ID NO: 7195 - protein, 10 aa, HIV-1
EVVIRSVNFT

SEQ ID NO: 7196 - protein, 10 aa, HIV-1
RSVNFTDNAK

SEQ ID NO: 7197 - protein, 10 aa, HIV-1
FTDNAKTIIV

SEQ ID NO: 7198 - protein, 10 aa, HIV-1
TIIVQLNTSV

SEQ ID NO: 7199 - protein, 10 aa, HIV-1
NTSVEINCTR

SEQ ID NO: 7200 - protein, 10 aa, HIV-1
CTRPNNNTRK

SEQ ID NO: 7201 - protein, 10 aa, HIV-1
RPNNNTRKRI

SEQ ID NO: 7202 - protein, 10 aa, HIV-1
NTRKRIRIQR

SEQ ID NO: 7203 - protein, 10 aa, HIV-1
RIRIQRGPGR

SEQ ID NO: 7204 - protein, 10 aa, HIV-1
RIQRGPGRAF

SEQ ID NO: 7205 - protein, 10 aa, HIV-1
IQRGPGRAFV

SEQ ID NO: 7206 - protein, 10 aa, HIV-1
PGRAFVTIGK

SEQ ID NO: 7207 - protein, 10 aa, HIV-1
FVTIGKIGNM

SEQ ID NO: 7208 - protein, 10 aa, HIV-1
VTIGKIGNMR

SEQ ID NO: 7209 - protein, 10 aa, HIV-1
MRQAHCNISR

SEQ ID NO: 7210 - protein, 10 aa, HIV-1
RQAHCNISRA

SEQ ID NO: 7211 - protein, 10 aa, HIV-1
QAHCNISRAK

SEQ ID NO: 7212 - protein, 10 aa, HIV-1
SRAKWNNTLK

SEQ ID NO: 7213 - protein, 10 aa, HIV-1
NTLKQIASKL

SEQ ID NO: 7214 - protein, 10 aa, HIV-1
TLKQIASKLR

SEQ ID NO: 7215 - protein, 10 aa, HIV-1
QIASKLREQF

SEQ ID NO: 7216 - protein, 10 aa, HIV-1
KLREQFGNNK

SEQ ID NO: 7217 - protein, 10 aa, HIV-1
REQFGNNKTI

SEQ ID NO: 7218 - protein, 10 aa, HIV-1
QFGNNKTIIF

SEQ ID NO: 7219 - protein, 10 aa, HIV-1
FGNNKTIIFK

SEQ ID NO: 7220 - protein, 10 aa, HIV-1
KQSSGGDPEI

SEQ ID NO: 7221 - protein, 10 aa, HIV-1
HSFNCGGEFF

SEQ ID NO: 7222 - protein, 10 aa, HIV-1
SFNCGGEFFY

SEQ ID NO: 7223 - protein, 10 aa, HIV-1
EFFYCNSTQL

SEQ ID NO: 7224 - protein, 10 aa, HIV-1
FFYCNSTQLF

SEQ ID NO: 7225 - protein, 10 aa, HIV-1
NSTQLFNSTW

SEQ ID NO: 7226 - protein, 10 aa, HIV-1
STQLFNSTWF

SEQ ID NO: 7227 - protein, 10 aa, HIV-1
QLFNSTWFNS

SEQ ID NO: 7228 - protein, 10 aa, HIV-1
STWFNSTWST

SEQ ID NO: 7229 - protein, 10 aa, HIV-1
GSDTITLPCR

SEQ ID NO: 7230 - protein, 10 aa, HIV-1
DTITLPCRIK

SEQ ID NO: 7231 - protein, 10 aa, HIV-1
TLPCRIKQII

SEQ ID NO: 7232 - protein, 10 aa, HIV-1
LPCRIKQIIN

SEQ ID NO: 7233 - protein, 10 aa, HIV-1
RIKQIINMWQ

SEQ ID NO: 7234 - protein, 10 aa, HIV-1
KQIINMWQKV

SEQ ID NO: 7235 - protein, 10 aa, HIV-1
IINMWQKVGK

SEQ ID NO: 7236 - protein, 10 aa, HIV-1
NMWQKVGKAM

SEQ ID NO: 7237 - protein, 10 aa, HIV-1
MWQKVGKAMY

SEQ ID NO: 7238 - protein, 10 aa, HIV-1
WQKVGKAMYA

SEQ ID NO: 7239 - protein, 10 aa, HIV-1
AMYAPPISGQ

SEQ ID NO: 7240 - protein, 10 aa, HIV-1
MYAPPISGQI

SEQ ID NO: 7241 - protein, 10 aa, HIV-1
YAPPISGQIR

SEQ ID NO: 7242 - protein, 10 aa, HIV-1
NSNNESEIFR

SEQ ID NO: 7243 - protein, 10 aa, HIV-1
EIFRPGGGDM

SEQ ID NO: 7244 - protein, 10 aa, HIV-1
DMRDNWRSEL

SEQ ID NO: 7245 - protein, 10 aa, HIV-1
MRDNWRSELY

SEQ ID NO: 7246 - protein, 10 aa, HIV-1
RDNWRSELYK

SEQ ID NO: 7247 - protein, 10 aa, HIV-1
SELYKYKVVK

SEQ ID NO: 7248 - protein, 10 aa, HIV-1
ELYKYKVVKI

SEQ ID NO: 7249 - protein, 10 aa, HIV-1
KYKVVKIEPL

SEQ ID NO: 7250 - protein, 10 aa, HIV-1
KVVKIEPLGV

SEQ ID NO: 7251 - protein, 10 aa, HIV-1
EPLGVAPTKA

SEQ ID NO: 7252 - protein, 10 aa, HIV-1
GVAPTKAKRR

SEQ ID NO: 7253 - protein, 10 aa, HIV-1
APTKAKRRVV

SEQ ID NO: 7254 - protein, 10 aa, HIV-1
TKAKRRVVQR

SEQ ID NO: 7255 - protein, 10 aa, HIV-1
AKRRVVQREK

SEQ ID NO: 7256 - protein, 10 aa, HIV-1
KRRVVQREKR

SEQ ID NO: 7257 - protein, 10 aa, HIV-1
RVVQREKRAV

SEQ ID NO: 7258 - protein, 10 aa, HIV-1
KRAVGIGALF

SEQ ID NO: 7259 - protein, 10 aa, HIV-1
RAVGIGALFL

SEQ ID NO: 7260 - protein, 10 aa, HIV-1
GIGALFLGFL

SEQ ID NO: 7261 - protein, 10 aa, HIV-1
ALFLGFLGAA

SEQ ID NO: 7262 - protein, 10 aa, HIV-1
FLGFLGAAGS

SEQ ID NO: 7263 - protein, 10 aa, HIV-1
FLGAAGSTMG

SEQ ID NO: 7264 - protein, 10 aa, HIV-1
LGAAGSTMGA

SEQ ID NO: 7265 - protein, 10 aa, HIV-1
GAAGSTMGAA

SEQ ID NO: 7266 - protein, 10 aa, HIV-1
STMGAASMTL

SEQ ID NO: 7267 - protein, 10 aa, HIV-1
TMGAASMTLT

SEQ ID NO: 7268 - protein, 10 aa, HIV-1
MGAASMTLTV

SEQ ID NO: 7269 - protein, 10 aa, HIV-1
ASMTLTVQAR

SEQ ID NO: 7270 - protein, 10 aa, HIV-1
SMTLTVQARQ

SEQ ID NO: 7271 - protein, 10 aa, HIV-1
MTLTVQARQL

SEQ ID NO: 7272 - protein, 10 aa, HIV-1
TLTVQARQLL

SEQ ID NO: 7273 - protein, 10 aa, HIV-1
VQARQLLSGI

SEQ ID NO: 7274 - protein, 10 aa, HIV-1
QLLSGIVQQQ

SEQ ID NO: 7275 - protein, 10 aa, HIV-1
GIVQQQNNLL

SEQ ID NO: 7276 - protein, 10 aa, HIV-1
IVQQQNNLLR

SEQ ID NO: 7277 - protein, 10 aa, HIV-1
VQQQNNLLRA

SEQ ID NO: 7278 - protein, 10 aa, HIV-1
QQQNNLLRAI

SEQ ID NO: 7279 - protein, 10 aa, HIV-1
NLLRAIEAQQ

SEQ ID NO: 7280 - protein, 10 aa, HIV-1
RAIEAQQHLL

SEQ ID NO: 7281 - protein, 10 aa, HIV-1
IEAQQHLLQL

SEQ ID NO: 7282 - protein, 10 aa, HIV-1
AQQHLLQLTV

SEQ ID NO: 7283 - protein, 10 aa, HIV-1
HLLQLTVWGI

SEQ ID NO: 7284 - protein, 10 aa, HIV-1
LLQLTVWGIK

SEQ ID NO: 7285 - protein, 10 aa, HIV-1
QLTVWGIKQL

SEQ ID NO: 7286 - protein, 10 aa, HIV-1
TVWGIKQLQA

SEQ ID NO: 7287 - protein, 10 aa, HIV-1
VWGIKQLQAR

SEQ ID NO: 7288 - protein, 10 aa, HIV-1
KQLQARILAV

SEQ ID NO: 7289 - protein, 10 aa, HIV-1
LQARILAVER

SEQ ID NO: 7290 - protein, 10 aa, HIV-1
RILAVERYLK

SEQ ID NO: 7291 - protein, 10 aa, HIV-1
VERYLKDQQL

SEQ ID NO: 7292 - protein, 10 aa, HIV-1
YLKDQQLLGI

SEQ ID NO: 7293 - protein, 10 aa, HIV-1
LLGIWGCSGK

SEQ ID NO: 7294 - protein, 10 aa, HIV-1
GIWGCSGKLI

SEQ ID NO: 7295 - protein, 10 aa, HIV-1
KLICTTAVPW

SEQ ID NO: 7296 - protein, 10 aa, HIV-1
CTTAVPWNAS

SEQ ID NO: 7297 - protein, 10 aa, HIV-1
TTAVPWNASW

SEQ ID NO: 7298 - protein, 10 aa, HIV-1
SWSNKSLEQI

SEQ ID NO: 7299 - protein, 10 aa, HIV-1
WSNKSLEQIW

SEQ ID NO: 7300 - protein, 10 aa, HIV-1
SLEQIWNHTT

SEQ ID NO: 7301 - protein, 10 aa, HIV-1
EQIWNHTTWM

SEQ ID NO: 7302 - protein, 10 aa, HIV-1
IWNHTTWMEW

SEQ ID NO: 7303 - protein, 10 aa, HIV-1
TTWMEWDREI

SEQ ID NO: 7304 - protein, 10 aa, HIV-1
MEWDREINNY

SEQ ID NO: 7305 - protein, 10 aa, HIV-1
REINNYTSLI

SEQ ID NO: 7306 - protein, 10 aa, HIV-1
NYTSLIHSLI

SEQ ID NO: 7307 - protein, 10 aa, HIV-1
SLIHSLIEES

SEQ ID NO: 7308 - protein, 10 aa, HIV-1
SLIEESQNQQ

SEQ ID NO: 7309 - protein, 10 aa, HIV-1
ELLELDKWAS

SEQ ID NO: 7310 - protein, 10 aa, HIV-1
LLELDKWASL

SEQ ID NO: 7311 - protein, 10 aa, HIV-1
WASLWNWFNI

SEQ ID NO: 7312 - protein, 10 aa, HIV-1
SLWNWFNITN

SEQ ID NO: 7313 - protein, 10 aa, HIV-1
LWNWFNITNW

SEQ ID NO: 7314 - protein, 10 aa, HIV-1
NWFNITNWLW

SEQ ID NO: 7315 - protein, 10 aa, HIV-1
WFNITNWLWY

SEQ ID NO: 7316 - protein, 10 aa, HIV-1
FNITNWLWYI

SEQ ID NO: 7317 - protein, 10 aa, HIV-1
NITNWLWYIK

SEQ ID NO: 7318 - protein, 10 aa, HIV-1
ITNWLWYIKL

SEQ ID NO: 7319 - protein, 10 aa, HIV-1
NWLWYIKLFI

SEQ ID NO: 7320 - protein, 10 aa, HIV-1
WLWYIKLFIM

SEQ ID NO: 7321 - protein, 10 aa, HIV-1
LWYIKLFIMI

SEQ ID NO: 7322 - protein, 10 aa, HIV-1
WYIKLFIMIV

SEQ ID NO: 7323 - protein, 10 aa, HIV-1
KLFIMIVGGL

SEQ ID NO: 7324 - protein, 10 aa, HIV-1
IMIVGGLVGL

SEQ ID NO: 7325 - protein, 10 aa, HIV-1
MIVGGLVGLR

SEQ ID NO: 7326 - protein, 10 aa, HIV-1
GLVGLRIVFA

SEQ ID NO: 7327 - protein, 10 aa, HIV-1
LVGLRIVFAV

SEQ ID NO: 7328 - protein, 10 aa, HIV-1
RIVFAVLSIV

SEQ ID NO: 7329 - protein, 10 aa, HIV-1
VFAVLSIVNR

SEQ ID NO: 7330 - protein, 10 aa, HIV-1
FAVLSIVNRV

SEQ ID NO: 7331 - protein, 10 aa, HIV-1
AVLSIVNRVR

SEQ ID NO: 7332 - protein, 10 aa, HIV-1
SIVNRVRQGY

SEQ ID NO: 7333 - protein, 10 aa, HIV-1
RVRQGYSPLS

SEQ ID NO: 7334 - protein, 10 aa, HIV-1
VRQGYSPLSF

SEQ ID NO: 7335 - protein, 10 aa, HIV-1
SFQTHLPTPR

SEQ ID NO: 7336 - protein, 10 aa, HIV-1
ERDRDRSIRL

SEQ ID NO: 7337 - protein, 10 aa, HIV-1
IRLVNGSLAL

SEQ ID NO: 7338 - protein, 10 aa, HIV-1
RLVNGSLALI

SEQ ID NO: 7339 - protein, 10 aa, HIV-1
LVNGSLALIW

SEQ ID NO: 7340 - protein, 10 aa, HIV-1
SLALIWDDLR

SEQ ID NO: 7341 - protein, 10 aa, HIV-1
ALIWDDLRSL

SEQ ID NO: 7342 - protein, 10 aa, HIV-1
LIWDDLRSLC

SEQ ID NO: 7343 - protein, 10 aa, HIV-1
DLRSLCLFSY

SEQ ID NO: 7344 - protein, 10 aa, HIV-1
RSLCLFSYHR

SEQ ID NO: 7345 - protein, 10 aa, HIV-1
SLCLFSYHRL

SEQ ID NO: 7346 - protein, 10 aa, HIV-1
LCLFSYHRLR

SEQ ID NO: 7347 - protein, 10 aa, HIV-1
FSYHRLRDLL

SEQ ID NO: 7348 - protein, 10 aa, HIV-1
SYHRLRDLLL

SEQ ID NO: 7349 - protein, 10 aa, HIV-1
RLRDLLLIVT

SEQ ID NO: 7350 - protein, 10 aa, HIV-1
DLLLIVTRIV

SEQ ID NO: 7351 - protein, 10 aa, HIV-1
LLIVTRIVEL

SEQ ID NO: 7352 - protein, 10 aa, HIV-1
LIVTRIVELL

SEQ ID NO: 7353 - protein, 10 aa, HIV-1
VTRIVELLGR

SEQ ID NO: 7354 - protein, 10 aa, HIV-1
ELLGRRGWEA

SEQ ID NO: 7355 - protein, 10 aa, HIV-1
LLGRRGWEAL

SEQ ID NO: 7356 - protein, 10 aa, HIV-1
LGRRGWEALK

SEQ ID NO: 7357 - protein, 10 aa, HIV-1
GRRGWEALKY

SEQ ID NO: 7358 - protein, 10 aa, HIV-1
RGWEALKYWW

SEQ ID NO: 7359 - protein, 10 aa, HIV-1
WEALKYWWNL

SEQ ID NO: 7360 - protein, 10 aa, HIV-1
EALKYWWNLL

SEQ ID NO: 7361 - protein, 10 aa, HIV-1
LKYWWNLLQY

SEQ ID NO: 7362 - protein, 10 aa, HIV-1
KYWWNLLQYW

SEQ ID NO: 7363 - protein, 10 aa, HIV-1
NLLQYWSQEL

SEQ ID NO: 7364 - protein, 10 aa, HIV-1
LLQYWSQELK

SEQ ID NO: 7365 - protein, 10 aa, HIV-1
WSQELKNSAV

SEQ ID NO: 7366 - protein, 10 aa, HIV-1
QELKNSAVSL

SEQ ID NO: 7367 - protein, 10 aa, HIV-1
ELKNSAVSLL

SEQ ID NO: 7368 - protein, 10 aa, HIV-1
SLLNATAIAV

SEQ ID NO: 7369 - protein, 10 aa, HIV-1
LLNATAIAVA

SEQ ID NO: 7370 - protein, 10 aa, HIV-1
IAVAEGTDRV

SEQ ID NO: 7371 - protein, 10 aa, HIV-1
AVAEGTDRVI

SEQ ID NO: 7372 - protein, 10 aa, HIV-1
AEGTDRVIEV

SEQ ID NO: 7373 - protein, 10 aa, HIV-1
EGTDRVIEVV

SEQ ID NO: 7374 - protein, 10 aa, HIV-1
EVVQGACRAI

SEQ ID NO: 7375 - protein, 10 aa, HIV-1
VVQGACRAIR

SEQ ID NO: 7376 - protein, 10 aa, HIV-1
ACRAIRHIPR

SEQ ID NO: 7377 - protein, 10 aa, HIV-1
AIRHIPRRIR

SEQ ID NO: 7378 - protein, 10 aa, HIV-1
HIPRRIRQGL

SEQ ID NO: 7379 - protein, 10 aa, HIV-1
RRIRQGLERI

SEQ ID NO: 7380 - protein, 10 aa, HIV-1
RIRQGLERIL

SEQ ID NO: 7381 - protein, 11 aa, HIV-1
RVKEKYQHLWR

SEQ ID NO: 7382 - protein, 11 aa, HIV-1
KYQHLWRWGWR

SEQ ID NO: 7383 - protein, 11 aa, HIV-1
YQHLWRWGWRW

SEQ ID NO: 7384 - protein, 11 aa, HIV-1
HLWRWGWRWGT

SEQ ID NO: 7385 - protein, 11 aa, HIV-1
WRWGWRWGTML

SEQ ID NO: 7386 - protein, 11 aa, HIV-1
RWGWRWGTMLL

SEQ ID NO: 7387 - protein, 11 aa, HIV-1
WRWGTMLLGML

SEQ ID NO: 7388 - protein, 11 aa, HIV-1
MLLGMLMICSA

SEQ ID NO: 7389 - protein, 11 aa, HIV-1
LLGMLMICSAT

SEQ ID NO: 7390 - protein, 11 aa, HIV-1
GMLMICSATEK

SEQ ID NO: 7391 - protein, 11 aa, HIV-1
MLMICSATEKL

SEQ ID NO: 7392 - protein, 11 aa, HIV-1
LMICSATEKLW

SEQ ID NO: 7393 - protein, 11 aa, HIV-1
MICSATEKLWV

SEQ ID NO: 7394 - protein, 11 aa, HIV-1
CSATEKLWVTV

SEQ ID NO: 7395 - protein, 11 aa, HIV-1
SATEKLWVTVY

SEQ ID NO: 7396 - protein, 11 aa, HIV-1
ATEKLWVTVYY

SEQ ID NO: 7397 - protein, 11 aa, HIV-1
EKLWVTVYYGV

SEQ ID NO: 7398 - protein, 11 aa, HIV-1
WVTVYYGVPVW

SEQ ID NO: 7399 - protein, 11 aa, HIV-1
VTVYYGVPVWK

SEQ ID NO: 7400 - protein, 11 aa, HIV-1
VPVWKEATTTL

SEQ ID NO: 7401 - protein, 11 aa, HIV-1
PVWKEATTTLF

SEQ ID NO: 7402 - protein, 11 aa, HIV-1
TTTLFCASDAK

SEQ ID NO: 7403 - protein, 11 aa, HIV-1
TTLFCASDAKA

SEQ ID NO: 7404 - protein, 11 aa, HIV-1
TLFCASDAKAY

SEQ ID NO: 7405 - protein, 11 aa, HIV-1
KAYDTEVHNVW

SEQ ID NO: 7406 - protein, 11 aa, HIV-1
NVWATHACVPT

SEQ ID NO: 7407 - protein, 11 aa, HIV-1
CVPTDPNPQEV

SEQ ID NO: 7408 - protein, 11 aa, HIV-1
VPTDPNPQEVV

SEQ ID NO: 7409 - protein, 11 aa, HIV-1
PTDPNPQEVVL

SEQ ID NO: 7410 - protein, 11 aa, HIV-1
NPQEVVLVNVT

SEQ ID NO: 7411 - protein, 11 aa, HIV-1
EVVLVNVTENF

SEQ ID NO: 7412 - protein, 11 aa, HIV-1
VLVNVTENFNM

SEQ ID NO: 7413 - protein, 11 aa, HIV-1
LVNVTENFNMW

SEQ ID NO: 7414 - protein, 11 aa, HIV-1
NMWKNDMVEQM

SEQ ID NO: 7415 - protein, 11 aa, HIV-1
DMVEQMHEDII

SEQ ID NO: 7416 - protein, 11 aa, HIV-1
VEQMHEDIISL

SEQ ID NO: 7417 - protein, 11 aa, HIV-1
DIISLWDQSLK

SEQ ID NO: 7418 - protein, 11 aa, HIV-1
SLWDQSLKPCV

SEQ ID NO: 7419 - protein, 11 aa, HIV-1
SLKPCVKLTPL

SEQ ID NO: 7420 - protein, 11 aa, HIV-1
KPCVKLTPLCV

SEQ ID NO: 7421 - protein, 11 aa, HIV-1
KLTPLCVSLKC

SEQ ID NO: 7422 - protein, 11 aa, HIV-1
DTNTNSSSGRM

SEQ ID NO: 7423 - protein, 11 aa, HIV-1
NTNSSSGRMIM

SEQ ID NO: 7424 - protein, 11 aa, HIV-1
NSSSGRMIMEK

SEQ ID NO: 7425 - protein, 11 aa, HIV-1
GRMIMEKGEIK

SEQ ID NO: 7426 - protein, 11 aa, HIV-1
MEKGEIKNCSF

SEQ ID NO: 7427 - protein, 11 aa, HIV-1
NCSFNISTSIR

SEQ ID NO: 7428 - protein, 11 aa, HIV-1
SFNISTSIRGK

SEQ ID NO: 7429 - protein, 11 aa, HIV-1
ISTSIRGKVQK

SEQ ID NO: 7430 - protein, 11 aa, HIV-1
TSIRGKVQKEY

SEQ ID NO: 7431 - protein, 11 aa, HIV-1
SIRGKVQKEYA

SEQ ID NO: 7432 - protein, 11 aa, HIV-1
KVQKEYAFFYK

SEQ ID NO: 7433 - protein, 11 aa, HIV-1
VQKEYAFFYKL

SEQ ID NO: 7434 - protein, 11 aa, HIV-1
KEYAFFYKLDI

SEQ ID NO: 7435 - protein, 11 aa, HIV-1
EYAFFYKLDII

SEQ ID NO: 7436 - protein, 11 aa, HIV-1
IIPIDNDTTSY

SEQ ID NO: 7437 - protein, 11 aa, HIV-1
IPIDNDTTSYK

SEQ ID NO: 7438 - protein, 11 aa, HIV-1
PIDNDTTSYKL

SEQ ID NO: 7439 - protein, 11 aa, HIV-1
KLTSCNTSVIT

SEQ ID NO: 7440 - protein, 11 aa, HIV-1
NTSVITQACPK

SEQ ID NO: 7441 - protein, 11 aa, HIV-1
QACPKVSFEPI

SEQ ID NO: 7442 - protein, 11 aa, HIV-1
CPKVSFEPIPI

SEQ ID NO: 7443 - protein, 11 aa, HIV-1
KVSFEPIPIHY

SEQ ID NO: 7444 - protein, 11 aa, HIV-1
EPIPIHYCAPA

SEQ ID NO: 7445 - protein, 11 aa, HIV-1
IPIHYCAPAGF

SEQ ID NO: 7446 - protein, 11 aa, HIV-1
HYCAPAGFAIL

SEQ ID NO: 7447 - protein, 11 aa, HIV-1
AGFAILKCNNK

SEQ ID NO: 7448 - protein, 11 aa, HIV-1
FAILKCNNKTF

SEQ ID NO: 7449 - protein, 11 aa, HIV-1
GTGPCTNVSTV

SEQ ID NO: 7450 - protein, 11 aa, HIV-1
NVSTVQCTHGI

SEQ ID NO: 7451 - protein, 11 aa, HIV-1
VSTVQCTHGIR

SEQ ID NO: 7452 - protein, 11 aa, HIV-1
TVQCTHGIRPV

SEQ ID NO: 7453 - protein, 11 aa, HIV-1
GIRPVVSTQLL

SEQ ID NO: 7454 - protein, 11 aa, HIV-1
LLLNGSLAEEE

SEQ ID NO: 7455 - protein, 11 aa, HIV-1
LLNGSLAEEEV

SEQ ID NO: 7456 - protein, 11 aa, HIV-1
SLAEEEVVIRS

SEQ ID NO: 7457 - protein, 11 aa, HIV-1
EEEVVIRSVNF

SEQ ID NO: 7458 - protein, 11 aa, HIV-1
EEVVIRSVNFT

SEQ ID NO: 7459 - protein, 11 aa, HIV-1
NFTDNAKTIIV

SEQ ID NO: 7460 - protein, 11 aa, HIV-1
KTIIVQLNTSV

SEQ ID NO: 7461 - protein, 11 aa, HIV-1
IIVQLNTSVEI

SEQ ID NO: 7462 - protein, 11 aa, HIV-1
QLNTSVEINCT

SEQ ID NO: 7463 - protein, 11 aa, HIV-1
LNTSVEINCTR

SEQ ID NO: 7464 - protein, 11 aa, HIV-1
CTRPNNNTRKR

SEQ ID NO: 7465 - protein, 11 aa, HIV-1
RPNNNTRKRIR

SEQ ID NO: 7466 - protein, 11 aa, HIV-1
NNTRKRIRIQR

SEQ ID NO: 7467 - protein, 11 aa, HIV-1
KRIRIQRGPGR

SEQ ID NO: 7468 - protein, 11 aa, HIV-1
RIQRGPGRAFV

SEQ ID NO: 7469 - protein, 11 aa, HIV-1
IQRGPGRAFVT

SEQ ID NO: 7470 - protein, 11 aa, HIV-1
FVTIGKIGNMR

SEQ ID NO: 7471 - protein, 11 aa, HIV-1
NMRQAHCNISR

SEQ ID NO: 7472 - protein, 11 aa, HIV-1
RQAHCNISRAK

SEQ ID NO: 7473 - protein, 11 aa, HIV-1
NISRAKWNNTL

SEQ ID NO: 7474 - protein, 11 aa, HIV-1
ISRAKWNNTLK

SEQ ID NO: 7475 - protein, 11 aa, HIV-1
NTLKQIASKLR

SEQ ID NO: 7476 - protein, 11 aa, HIV-1
KQIASKLREQF

SEQ ID NO: 7477 - protein, 11 aa, HIV-1
KLREQFGNNKT

SEQ ID NO: 7478 - protein, 11 aa, HIV-1
REQFGNNKTII

SEQ ID NO: 7479 - protein, 11 aa, HIV-1
EQFGNNKTIIF

SEQ ID NO: 7480 - protein, 11 aa, HIV-1
QFGNNKTIIFK

SEQ ID NO: 7481 - protein, 11 aa, HIV-1
KQSSGGDPEIV

SEQ ID NO: 7482 - protein, 11 aa, HIV-1
HSFNCGGEFFY

SEQ ID NO: 7483 - protein, 11 aa, HIV-1
GEFFYCNSTQL

SEQ ID NO: 7484 - protein, 11 aa, HIV-1
EFFYCNSTQLF

SEQ ID NO: 7485 - protein, 11 aa, HIV-1
QLFNSTWFNST

SEQ ID NO: 7486 - protein, 11 aa, HIV-1
LFNSTWFNSTW

SEQ ID NO: 7487 - protein, 11 aa, HIV-1
STWSTEGSNNT

SEQ ID NO: 7488 - protein, 11 aa, HIV-1
EGSDTITLPCR

SEQ ID NO: 7489 - protein, 11 aa, HIV-1
LPCRIKQIINM

SEQ ID NO: 7490 - protein, 11 aa, HIV-1
RIKQIINMWQK

SEQ ID NO: 7491 - protein, 11 aa, HIV-1
QIINMWQKVGK

SEQ ID NO: 7492 - protein, 11 aa, HIV-1
IINMWQKVGKA

SEQ ID NO: 7493 - protein, 11 aa, HIV-1
NMWQKVGKAMY

SEQ ID NO: 7494 - protein, 11 aa, HIV-1
KVGKAMYAPPI

SEQ ID NO: 7495 - protein, 11 aa, HIV-1
AMYAPPISGQI

SEQ ID NO: 7496 - protein, 11 aa, HIV-1
MYAPPISGQIR

SEQ ID NO: 7497 - protein, 11 aa, HIV-1
QIRCSSNITGL

SEQ ID NO: 7498 - protein, 11 aa, HIV-1
SSNITGLLLTR

SEQ ID NO: 7499 - protein, 11 aa, HIV-1
SEIFRPGGGDM

SEQ ID NO: 7500 - protein, 11 aa, HIV-1
EIFRPGGGDMR

SEQ ID NO: 7501 - protein, 11 aa, HIV-1
RPGGGDMRDNW

SEQ ID NO: 7502 - protein, 11 aa, HIV-1
DMRDNWRSELY

SEQ ID NO: 7503 - protein, 11 aa, HIV-1
RSELYKYKVVK

SEQ ID NO: 7504 - protein, 11 aa, HIV-1
YKYKVVKIEPL

SEQ ID NO: 7505 - protein, 11 aa, HIV-1
KIEPLGVAPTK

SEQ ID NO: 7506 - protein, 11 aa, HIV-1
GVAPTKAKRRV

SEQ ID NO: 7507 - protein, 11 aa, HIV-1
APTKAKRRVVQ

SEQ ID NO: 7508 - protein, 11 aa, HIV-1
PTKAKRRVVQR

SEQ ID NO: 7509 - protein, 11 aa, HIV-1
KAKRRVVQREK

SEQ ID NO: 7510 - protein, 11 aa, HIV-1
RRVVQREKRAV

SEQ ID NO: 7511 - protein, 11 aa, HIV-1
REKRAVGIGAL

SEQ ID NO: 7512 - protein, 11 aa, HIV-1
AVGIGALFLGF

SEQ ID NO: 7513 - protein, 11 aa, HIV-1
FLGFLGAAGST

SEQ ID NO: 7514 - protein, 11 aa, HIV-1
FLGAAGSTMGA

SEQ ID NO: 7515 - protein, 11 aa, HIV-1
STMGAASMTLT

SEQ ID NO: 7516 - protein, 11 aa, HIV-1
TMGAASMTLTV

SEQ ID NO: 7517 - protein, 11 aa, HIV-1
AASMTLTVQAR

SEQ ID NO: 7518 - protein, 11 aa, HIV-1
SMTLTVQARQL

SEQ ID NO: 7519 - protein, 11 aa, HIV-1
MTLTVQARQLL

SEQ ID NO: 7520 - protein, 11 aa, HIV-1
TVQARQLLSGI

SEQ ID NO: 7521 - protein, 11 aa, HIV-1
VQARQLLSGIV

SEQ ID NO: 7522 - protein, 11 aa, HIV-1
GIVQQQNNLLR

SEQ ID NO: 7523 - protein, 11 aa, HIV-1
VQQQNNLLRAI

SEQ ID NO: 7524 - protein, 11 aa, HIV-1
QQNNLLRAIEA

SEQ ID NO: 7525 - protein, 11 aa, HIV-1
LLRAIEAQQHL

SEQ ID NO: 7526 - protein, 11 aa, HIV-1
AIEAQQHLLQL

SEQ ID NO: 7527 - protein, 11 aa, HIV-1
EAQQHLLQLTV

SEQ ID NO: 7528 - protein, 11 aa, HIV-1
HLLQLTVWGIK

SEQ ID NO: 7529 - protein, 11 aa, HIV-1
LQLTVWGIKQL

SEQ ID NO: 7530 - protein, 11 aa, HIV-1
QLTVWGIKQLQ

SEQ ID NO: 7531 - protein, 11 aa, HIV-1
TVWGIKQLQAR

SEQ ID NO: 7532 - protein, 11 aa, HIV-1
VWGIKQLQARI

SEQ ID NO: 7533 - protein, 11 aa, HIV-1
KQLQARILAVE

SEQ ID NO: 7534 - protein, 11 aa, HIV-1
QLQARILAVER

SEQ ID NO: 7535 - protein, 11 aa, HIV-1
LQARILAVERY

SEQ ID NO: 7536 - protein, 11 aa, HIV-1
ARILAVERYLK

SEQ ID NO: 7537 - protein, 11 aa, HIV-1
AVERYLKDQQL

SEQ ID NO: 7538 - protein, 11 aa, HIV-1
VERYLKDQQLL

SEQ ID NO: 7539 - protein, 11 aa, HIV-1
RYLKDQQLLGI

SEQ ID NO: 7540 - protein, 11 aa, HIV-1
QLLGIWGCSGK

SEQ ID NO: 7541 - protein, 11 aa, HIV-1
LLGIWGCSGKL

SEQ ID NO: 7542 - protein, 11 aa, HIV-1
CTTAVPWNASW

SEQ ID NO: 7543 - protein, 11 aa, HIV-1
TTAVPWNASWS

SEQ ID NO: 7544 - protein, 11 aa, HIV-1
AVPWNASWSNK

SEQ ID NO: 7545 - protein, 11 aa, HIV-1
VPWNASWSNKS

SEQ ID NO: 7546 - protein, 11 aa, HIV-1
QIWNHTTWMEW

SEQ ID NO: 7547 - protein, 11 aa, HIV-1
WMEWDREINNY

SEQ ID NO: 7548 - protein, 11 aa, HIV-1
WDREINNYTSL

SEQ ID NO: 7549 - protein, 11 aa, HIV-1
SLIHSLIEESQ

SEQ ID NO: 7550 - protein, 11 aa, HIV-1
SLIEESQNQQE

SEQ ID NO: 7551 - protein, 11 aa, HIV-1
QEKNEQELLEL

SEQ ID NO: 7552 - protein, 11 aa, HIV-1
ELLELDKWASL

SEQ ID NO: 7553 - protein, 11 aa, HIV-1
KWASLWNWFNI

SEQ ID NO: 7554 - protein, 11 aa, HIV-1
WASLWNWFNIT

SEQ ID NO: 7555 - protein, 11 aa, HIV-1
SLWNWFNITNW

SEQ ID NO: 7556 - protein, 11 aa, HIV-1
LWNWFNITNWL

SEQ ID NO: 7557 - protein, 11 aa, HIV-1
NWFNITNWLWY

SEQ ID NO: 7558 - protein, 11 aa, HIV-1
WFNITNWLWYI

SEQ ID NO: 7559 - protein, 11 aa, HIV-1
NITNWLWYIKL

SEQ ID NO: 7560 - protein, 11 aa, HIV-1
ITNWLWYIKLF

SEQ ID NO: 7561 - protein, 11 aa, HIV-1
WLWYIKLFIMI

SEQ ID NO: 7562 - protein, 11 aa, HIV-1
KLFIMIVGGLV

SEQ ID NO: 7563 - protein, 11 aa, HIV-1
FIMIVGGLVGL

SEQ ID NO: 7564 - protein, 11 aa, HIV-1
IMIVGGLVGLR

SEQ ID NO: 7565 - protein, 11 aa, HIV-1
MIVGGLVGLRI

SEQ ID NO: 7566 - protein, 11 aa, HIV-1
IVGGLVGLRIV

SEQ ID NO: 7567 - protein, 11 aa, HIV-1
GLVGLRIVFAV

SEQ ID NO: 7568 - protein, 11 aa, HIV-1
GLRIVFAVLSI

SEQ ID NO: 7569 - protein, 11 aa, HIV-1
IVFAVLSIVNR

SEQ ID NO: 7570 - protein, 11 aa, HIV-1
FAVLSIVNRVR

SEQ ID NO: 7571 - protein, 11 aa, HIV-1
LSIVNRVRQGY

SEQ ID NO: 7572 - protein, 11 aa, HIV-1
RVRQGYSPLSF

SEQ ID NO: 7573 - protein, 11 aa, HIV-1
RQGYSPLSFQT

SEQ ID NO: 7574 - protein, 11 aa, HIV-1
GYSPLSFQTHL

SEQ ID NO: 7575 - protein, 11 aa, HIV-1
SPLSFQTHLPT

SEQ ID NO: 7576 - protein, 11 aa, HIV-1
LSFQTHLPTPR

SEQ ID NO: 7577 - protein, 11 aa, HIV-1
TPRGPDRPEGI

SEQ ID NO: 7578 - protein, 11 aa, HIV-1
GERDRDRSIRL

SEQ ID NO: 7579 - protein, 11 aa, HIV-1
SIRLVNGSLAL

SEQ ID NO: 7580 - protein, 11 aa, HIV-1
RLVNGSLALIW

SEQ ID NO: 7581 - protein, 11 aa, HIV-1
GSLALIWDDLR

SEQ ID NO: 7582 - protein, 11 aa, HIV-1
ALIWDDLRSLC

SEQ ID NO: 7583 - protein, 11 aa, HIV-1
LIWDDLRSLCL

SEQ ID NO: 7584 - protein, 11 aa, HIV-1
IWDDLRSLCLF

SEQ ID NO: 7585 - protein, 11 aa, HIV-1
SLCLFSYHRLR

SEQ ID NO: 7586 - protein, 11 aa, HIV-1
CLFSYHRLRDL

SEQ ID NO: 7587 - protein, 11 aa, HIV-1
SYHRLRDLLLI

SEQ ID NO: 7588 - protein, 11 aa, HIV-1
RLRDLLLIVTR

SEQ ID NO: 7589 - protein, 11 aa, HIV-1
LLLIVTRIVEL

SEQ ID NO: 7590 - protein, 11 aa, HIV-1
LLIVTRIVELL

SEQ ID NO: 7591 - protein, 11 aa, HIV-1
IVTRIVELLGR

SEQ ID NO: 7592 - protein, 11 aa, HIV-1
VTRIVELLGRR

SEQ ID NO: 7593 - protein, 11 aa, HIV-1
ELLGRRGWEAL

SEQ ID NO: 7594 - protein, 11 aa, HIV-1
LLGRRGWEALK

SEQ ID NO: 7595 - protein, 11 aa, HIV-1
GWEALKYWWNL

SEQ ID NO: 7596 - protein, 11 aa, HIV-1
WEALKYWWNLL

SEQ ID NO: 7597 - protein, 11 aa, HIV-1
ALKYWWNLLQY

SEQ ID NO: 7598 - protein, 11 aa, HIV-1
LKYWWNLLQYW

SEQ ID NO: 7599 - protein, 11 aa, HIV-1
NLLQYWSQELK

SEQ ID NO: 7600 - protein, 11 aa, HIV-1
SQELKNSAVSL

SEQ ID NO: 7601 - protein, 11 aa, HIV-1
QELKNSAVSLL

SEQ ID NO: 7602 - protein, 11 aa, HIV-1
SAVSLLNATAI

SEQ ID NO: 7603 - protein, 11 aa, HIV-1
AVSLLNATAIA

SEQ ID NO: 7604 - protein, 11 aa, HIV-1
SLLNATAIAVA

SEQ ID NO: 7605 - protein, 11 aa, HIV-1
NATAIAVAEGT

SEQ ID NO: 7606 - protein, 11 aa, HIV-1
TAIAVAEGTDR

SEQ ID NO: 7607 - protein, 11 aa, HIV-1
AIAVAEGTDRV

SEQ ID NO: 7608 - protein, 11 aa, HIV-1
VAEGTDRVIEV

SEQ ID NO: 7609 - protein, 11 aa, HIV-1
AEGTDRVIEVV

SEQ ID NO: 7610 - protein, 11 aa, HIV-1
RVIEVVQGACR

SEQ ID NO: 7611 - protein, 11 aa, HIV-1
EVVQGACRAIR

SEQ ID NO: 7612 - protein, 11 aa, HIV-1
GACRAIRHIPR

SEQ ID NO: 7613 - protein, 11 aa, HIV-1
ACRAIRHIPRR

SEQ ID NO: 7614 - protein, 11 aa, HIV-1
RAIRHIPRRIR

SEQ ID NO: 7615 - protein, 11 aa, HIV-1
RRIRQGLERIL

SEQ ID NO: 7616 - protein, 11 aa, HIV-1
RIRQGLERILL

SEQ ID NO: 7617 - protein, 15 aa, HIV-1
ACRAIRHIPRRIRQG

SEQ ID NO: 7618 - protein, 9 aa, HIV-1
IRHIPRRIR

SEQ ID NO: 7619 - protein, 15 aa, HIV-1
ACVPTDPNPQEVVLV

SEQ ID NO: 7620 - protein, 9 aa, HIV-1
VPTDPNPQE

SEQ ID NO: 7621 - protein, 15 aa, HIV-1
AEEEVVIRSVNFTDN

SEQ ID NO: 7622 - protein, 9 aa, HIV-1
VVIRSVNFT

SEQ ID NO: 7623 - protein, 15 aa, HIV-1
AFFYKLDIIPIDNDT

SEQ ID NO: 7624 - protein, 9 aa, HIV-1
YKLDIIPID

SEQ ID NO: 7625 - protein, 15 aa, HIV-1
AGSTMGAASMTLTVQ

SEQ ID NO: 7626 - protein, 9 aa, HIV-1
MGAASMTLT

SEQ ID NO: 7627 - protein, 15 aa, HIV-1
AKTIIVQLNTSVEIN

SEQ ID NO: 7628 - protein, 9 aa, HIV-1
IVQLNTSVE

SEQ ID NO: 7629 - protein, 15 aa, HIV-1
AKTIIVQLNTSVEIN

SEQ ID NO: 7630 - protein, 9 aa, HIV-1
VQLNTSVEI

SEQ ID NO: 7631 - protein, 15 aa, HIV-1
AKWNNTLKQIASKLR

SEQ ID NO: 7632 - protein, 9 aa, HIV-1
NTLKQIASK

SEQ ID NO: 7633 - protein, 15 aa, HIV-1
AKWNNTLKQIASKLR

SEQ ID NO: 7634 - protein, 9 aa, HIV-1
TLKQIASKL

SEQ ID NO: 7635 - protein, 15 aa, HIV-1
AKWNNTLKQIASKLR

SEQ ID NO: 7636 - protein, 9 aa, HIV-1
WNNTLKQIA

SEQ ID NO: 7637 - protein, 15 aa, HIV-1
ALFLGFLGAAGSTMG

SEQ ID NO: 7638 - protein, 9 aa, HIV-1
FLGFLGAAG

SEQ ID NO: 7639 - protein, 15 aa, HIV-1
ALFLGFLGAAGSTMG

SEQ ID NO: 7640 - protein, 9 aa, HIV-1
FLGAAGSTM

SEQ ID NO: 7641 - protein, 15 aa, HIV-1
ALIWDDLRSLCLFSY

SEQ ID NO: 7642 - protein, 9 aa, HIV-1
WDDLRSLCL

SEQ ID NO: 7643 - protein, 15 aa, HIV-1
ALKYWWNLLQYWSQE

SEQ ID NO: 7644 - protein, 9 aa, HIV-1
LKYWWNLLQ

SEQ ID NO: 7645 - protein, 15 aa, HIV-1
ALKYWWNLLQYWSQE

SEQ ID NO: 7646 - protein, 9 aa, HIV-1
WWNLLQYWS

SEQ ID NO: 7647 - protein, 15 aa, HIV-1
ALKYWWNLLQYWSQE

SEQ ID NO: 7648 - protein, 9 aa, HIV-1
YWWNLLQYW

SEQ ID NO: 7649 - protein, 15 aa, HIV-1
AMYAPPISGQIRCSS

SEQ ID NO: 7650 - protein, 9 aa, HIV-1
YAPPISGQI

SEQ ID NO: 7651 - protein, 15 aa, HIV-1
AQQHLLQLTVWGIKQ

SEQ ID NO: 7652 - protein, 9 aa, HIV-1
LLQLTVWGI

SEQ ID NO: 7653 - protein, 15 aa, HIV-1
ARQLLSGIVQQQNNL

SEQ ID NO: 7654 - protein, 9 aa, HIV-1
LLSGIVQQQ

SEQ ID NO: 7655 - protein, 15 aa, HIV-1
ASLWNWFNITNWLWY

SEQ ID NO: 7656 - protein, 9 aa, HIV-1
LWNWFNITN

SEQ ID NO: 7657 - protein, 15 aa, HIV-1
ASLWNWFNITNWLWY

SEQ ID NO: 7658 - protein, 9 aa, HIV-1
WFNITNWLW

SEQ ID NO: 7659 - protein, 15 aa, HIV-1
ASLWNWFNITNWLWY

SEQ ID NO: 7660 - protein, 9 aa, HIV-1
WNWFNITNW

SEQ ID NO: 7661 - protein, 15 aa, HIV-1
ASMTLTVQARQLLSG

SEQ ID NO: 7662 - protein, 9 aa, HIV-1
LTVQARQLL

SEQ ID NO: 7663 - protein, 15 aa, HIV-1
ATAIAVAEGTDRVIE

SEQ ID NO: 7664 - protein, 9 aa, HIV-1
IAVAEGTDR

SEQ ID NO: 7665 - protein, 15 aa, HIV-1
ATEKLWVTVYYGVPV

SEQ ID NO: 7666 - protein, 9 aa, HIV-1
EKLWVTVYY

SEQ ID NO: 7667 - protein, 15 aa, HIV-1
ATHACVPTDPNPQEV

SEQ ID NO: 7668 - protein, 9 aa, HIV-1
VPTDPNPQE

SEQ ID NO: 7669 - protein, 15 aa, HIV-1
ATTTLFCASDAKAYD

SEQ ID NO: 7670 - protein, 9 aa, HIV-1
FCASDAKAY

SEQ ID NO: 7671 - protein, 15 aa, HIV-1
AVGIGALFLGFLGAA

SEQ ID NO: 7672 - protein, 9 aa, HIV-1
AVGIGALFL

SEQ ID NO: 7673 - protein, 15 aa, HIV-1
AVLSIVNRVRQGYSP

SEQ ID NO: 7674 - protein, 9 aa, HIV-1
LSIVNRVRQ

SEQ ID NO: 7675 - protein, 15 aa, HIV-1
AVPWNASWSNKSLEQ

SEQ ID NO: 7676 - protein, 9 aa, HIV-1
WNASWSNKS

SEQ ID NO: 7677 - protein, 15 aa, HIV-1
AVSLLNATAIAVAEG

SEQ ID NO: 7678 - protein, 9 aa, HIV-1
LLNATAIAV

SEQ ID NO: 7679 - protein, 15 aa, HIV-1
AYDTEVHNVWATHAC

SEQ ID NO: 7680 - protein, 9 aa, HIV-1
VHNVWATHA

SEQ ID NO: 7681 - protein, 15 aa, HIV-1
CGGEFFYCNSTQLFN

SEQ ID NO: 7682 - protein, 9 aa, HIV-1
FYCNSTQLF

SEQ ID NO: 7683 - protein, 15 aa, HIV-1
CLFSYHRLRDLLLIV

SEQ ID NO: 7684 - protein, 9 aa, HIV-1
YHRLRDLLL

SEQ ID NO: 7685 - protein, 15 aa, HIV-1
CNISRAKWNNTLKQI

SEQ ID NO: 7686 - protein, 9 aa, HIV-1
RAKWNNTLK

SEQ ID NO: 7687 - protein, 15 aa, HIV-1
CNNKTFNGTGPCTNV

SEQ ID NO: 7688 - protein, 9 aa, HIV-1
FNGTGPCTN

SEQ ID NO: 7689 - protein, 15 aa, HIV-1
CNSTQLFNSTWFNST

SEQ ID NO: 7690 - protein, 9 aa, HIV-1
LFNSTWFNS

SEQ ID NO: 7691 - protein, 15 aa, HIV-1
CNTSVITQACPKVSF

SEQ ID NO: 7692 - protein, 9 aa, HIV-1
ITQACPKVS

SEQ ID NO: 7693 - protein, 15 aa, HIV-1
CRAIRHIPRRIRQGL

SEQ ID NO: 7694 - protein, 9 aa, HIV-1
IRHIPRRIR

SEQ ID NO: 7695 - protein, 15 aa, HIV-1
CRIKQIINMWQKVGK

SEQ ID NO: 7696 - protein, 9 aa, HIV-1
IINMWQKVG

SEQ ID NO: 7697 - protein, 15 aa, HIV-1
CRIKQIINMWQKVGK

SEQ ID NO: 7698 - protein, 9 aa, HIV-1
IKQIINMWQ

SEQ ID NO: 7699 - protein, 15 aa, HIV-1
CSFNISTSIRGKVQK

SEQ ID NO: 7700 - protein, 9 aa, HIV-1
FNISTSIRG

SEQ ID NO: 7701 - protein, 15 aa, HIV-1
CSGKLICTTAVPWNA

SEQ ID NO: 7702 - protein, 9 aa, HIV-1
GKLICTTAV

SEQ ID NO: 7703 - protein, 15 aa, HIV-1
CSGKLICTTAVPWNA

SEQ ID NO: 7704 - protein, 9 aa, HIV-1
LICTTAVPW

SEQ ID NO: 7705 - protein, 15 aa, HIV-1
CSSNITGLLLTRDGG

SEQ ID NO: 7706 - protein, 9 aa, HIV-1
ITGLLLTRD

SEQ ID NO: 7707 - protein, 15 aa, HIV-1
CTDLKNDTNTNSSSG

SEQ ID NO: 7708 - protein, 9 aa, HIV-1
LKNDTNTNS

SEQ ID NO: 7709 - protein, 15 aa, HIV-1
CTHGIRPVVSTQLLL

SEQ ID NO: 7710 - protein, 9 aa, HIV-1
IRPVVSTQL

SEQ ID NO: 7711 - protein, 15 aa, HIV-1
CTRPNNNTRKRIRIQ

SEQ ID NO: 7712 - protein, 9 aa, HIV-1
PNNNTRKRI

SEQ ID NO: 7713 - protein, 15 aa, HIV-1
CTTAVPWNASWSNKS

SEQ ID NO: 7714 - protein, 9 aa, HIV-1
AVPWNASWS

SEQ ID NO: 7715 - protein, 15 aa, HIV-1
CTTAVPWNASWSNKS

SEQ ID NO: 7716 - protein, 9 aa, HIV-1
CTTAVPWNA

SEQ ID NO: 7717 - protein, 15 aa, HIV-1
CTTAVPWNASWSNKS

SEQ ID NO: 7718 - protein, 9 aa, HIV-1
TTAVPWNAS

SEQ ID NO: 7719 - protein, 15 aa, HIV-1
CTTAVPWNASWSNKS

SEQ ID NO: 7720 - protein, 9 aa, HIV-1
VPWNASWSN

SEQ ID NO: 7721 - protein, 15 aa, HIV-1
CVKLTPLCVSLKCTD

SEQ ID NO: 7722 - protein, 9 aa, HIV-1
LTPLCVSLK

SEQ ID NO: 7723 - protein, 15 aa, HIV-1
DDLRSLCLFSYHRLR

SEQ ID NO: 7724 - protein, 9 aa, HIV-1
LRSLCLFSY

SEQ ID NO: 7725 - protein, 15 aa, HIV-1
DIISLWDQSLKPCVK

SEQ ID NO: 7726 - protein, 9 aa, HIV-1
LWDQSLKPC

SEQ ID NO: 7727 - protein, 15 aa, HIV-1
DKWASLWNWFNITNW

SEQ ID NO: 7728 - protein, 9 aa, HIV-1
WASLWNWFN

SEQ ID NO: 7729 - protein, 15 aa, HIV-1
DLLLIVTRIVELLGR

SEQ ID NO: 7730 - protein, 9 aa, HIV-1
IVTRIVELL

SEQ ID NO: 7731 - protein, 15 aa, HIV-1
DLLLIVTRIVELLGR

SEQ ID NO: 7732 - protein, 9 aa, HIV-1
LIVTRIVEL

SEQ ID NO: 7733 - protein, 15 aa, HIV-1
DLLLIVTRIVELLGR

SEQ ID NO: 7734 - protein, 9 aa, HIV-1
LLIVTRIVE

SEQ ID NO: 7735 - protein, 15 aa, HIV-1
DLRSLCLFSYHRLRD

SEQ ID NO: 7736 - protein, 9 aa, HIV-1
LRSLCLFSY

SEQ ID NO: 7737 - protein, 15 aa, HIV-1
DMRDNWRSELYKYKV

SEQ ID NO: 7738 - protein, 9 aa, HIV-1
WRSELYKYK

SEQ ID NO: 7739 - protein, 15 aa, HIV-1
DNAKTIIVQLNTSVE

SEQ ID NO: 7740 - protein, 9 aa, HIV-1
IIVQLNTSV

SEQ ID NO: 7741 - protein, 15 aa, HIV-1
DNAKTIIVQLNTSVE

SEQ ID NO: 7742 - protein, 9 aa, HIV-1
TIIVQLNTS

SEQ ID NO: 7743 - protein, 15 aa, HIV-1
DNWRSELYKYKVVKI

SEQ ID NO: 7744 - protein, 9 aa, HIV-1
WRSELYKYK

SEQ ID NO: 7745 - protein, 15 aa, HIV-1
DRDRSIRLVNGSLAL

SEQ ID NO: 7746 - protein, 9 aa, HIV-1
IRLVNGSLA

SEQ ID NO: 7747 - protein, 15 aa, HIV-1
DREINNYTSLIHSLI

SEQ ID NO: 7748 - protein, 9 aa, HIV-1
INNYTSLIH

SEQ ID NO: 7749 - protein, 15 aa, HIV-1
DRSIRLVNGSLALIW

SEQ ID NO: 7750 - protein, 9 aa, HIV-1
IRLVNGSLA

SEQ ID NO: 7751 - protein, 15 aa, HIV-1
DRSIRLVNGSLALIW

SEQ ID NO: 7752 - protein, 9 aa, HIV-1
LVNGSLALI

SEQ ID NO: 7753 - protein, 15 aa, HIV-1
DRVIEVVQGACRAIR

SEQ ID NO: 7754 - protein, 9 aa, HIV-1
VVQGACRAI

SEQ ID NO: 7755 - protein, 15 aa, HIV-1
DTEVHNVWATHACVP

SEQ ID NO: 7756 - protein, 9 aa, HIV-1
VHNVWATHA

SEQ ID NO: 7757 - protein, 15 aa, HIV-1
DTTSYKLTSCNTSVI

SEQ ID NO: 7758 - protein, 9 aa, HIV-1
SYKLTSCNT

SEQ ID NO: 7759 - protein, 15 aa, HIV-1
DTTSYKLTSCNTSVI

SEQ ID NO: 7760 - protein, 9 aa, HIV-1
YKLTSCNTS

SEQ ID NO: 7761 - protein, 15 aa, HIV-1
EALKYWWNLLQYWSQ

SEQ ID NO: 7762 - protein, 9 aa, HIV-1
LKYWWNLLQ

SEQ ID NO: 7763 - protein, 15 aa, HIV-1
EALKYWWNLLQYWSQ

SEQ ID NO: 7764 - protein, 9 aa, HIV-1
WWNLLQYWS

SEQ ID NO: 7765 - protein, 15 aa, HIV-1
EALKYWWNLLQYWSQ

SEQ ID NO: 7766 - protein, 9 aa, HIV-1
YWWNLLQYW

SEQ ID NO: 7767 - protein, 15 aa, HIV-1
EAQQHLLQLTVWGIK

SEQ ID NO: 7768 - protein, 9 aa, HIV-1
LLQLTVWGI

SEQ ID NO: 7769 - protein, 15 aa, HIV-1
EATTTLFCASDAKAY

SEQ ID NO: 7770 - protein, 9 aa, HIV-1
LFCASDAKA

SEQ ID NO: 7771 - protein, 15 aa, HIV-1
EDIISLWDQSLKPCV

SEQ ID NO: 7772 - protein, 9 aa, HIV-1
LWDQSLKPC

SEQ ID NO: 7773 - protein, 15 aa, HIV-1
EEEVVIRSVNFTDNA

SEQ ID NO: 7774 - protein, 9 aa, HIV-1
VVIRSVNFT

SEQ ID NO: 7775 - protein, 15 aa, HIV-1
EEVVIRSVNFTDNAK

SEQ ID NO: 7776 - protein, 9 aa, HIV-1
VVIRSVNFT

SEQ ID NO: 7777 - protein, 15 aa, HIV-1
EFFYCNSTQLFNSTW

SEQ ID NO: 7778 - protein, 9 aa, HIV-1
FYCNSTQLF

SEQ ID NO: 7779 - protein, 15 aa, HIV-1
EIKNCSFNISTSIRG

SEQ ID NO: 7780 - protein, 9 aa, HIV-1
IKNCSFNIS

SEQ ID NO: 7781 - protein, 15 aa, HIV-1
EIKNCSFNISTSIRG

SEQ ID NO: 7782 - protein, 9 aa, HIV-1
SFNISTSIR

SEQ ID NO: 7783 - protein, 15 aa, HIV-1
EINCTRPNNNTRKRI

SEQ ID NO: 7784 - protein, 9 aa, HIV-1
RPNNNTRKR

SEQ ID NO: 7785 - protein, 15 aa, HIV-1
EINCTRPNNNTRKRI

SEQ ID NO: 7786 - protein, 9 aa, HIV-1
TRPNNNTRK

SEQ ID NO: 7787 - protein, 15 aa, HIV-1
EINNYTSLIHSLIEE

SEQ ID NO: 7788 - protein, 9 aa, HIV-1
YTSLIHSLI

SEQ ID NO: 7789 - protein, 15 aa, HIV-1
EKGEIKNCSFNISTS

SEQ ID NO: 7790 - protein, 9 aa, HIV-1
IKNCSFNIS

SEQ ID NO: 7791 - protein, 15 aa, HIV-1
EKRAVGIGALFLGFL

SEQ ID NO: 7792 - protein, 9 aa, HIV-1
VGIGALFLG

SEQ ID NO: 7793 - protein, 15 aa, HIV-1
EKYQHLWRWGWRWGT

SEQ ID NO: 7794 - protein, 9 aa, HIV-1
LWRWGWRWG

SEQ ID NO: 7795 - protein, 15 aa, HIV-1
EKYQHLWRWGWRWGT

SEQ ID NO: 7796 - protein, 9 aa, HIV-1
QHLWRWGWR

SEQ ID NO: 7797 - protein, 15 aa, HIV-1
EKYQHLWRWGWRWGT

SEQ ID NO: 7798 - protein, 9 aa, HIV-1
YQHLWRWGW

SEQ ID NO: 7799 - protein, 15 aa, HIV-1
ELDKWASLWNWFNIT

SEQ ID NO: 7800 - protein, 9 aa, HIV-1
WASLWNWFN

SEQ ID NO: 7801 - protein, 15 aa, HIV-1
ELKNSAVSLLNATAI

SEQ ID NO: 7802 - protein, 9 aa, HIV-1
LKNSAVSLL

SEQ ID NO: 7803 - protein, 15 aa, HIV-1
ELLELDKWASLWNWF

SEQ ID NO: 7804 - protein, 9 aa, HIV-1
LDKWASLWN

SEQ ID NO: 7805 - protein, 15 aa, HIV-1
ELYKYKVVKIEPLGV

SEQ ID NO: 7806 - protein, 9 aa, HIV-1
YKVVKIEPL

SEQ ID NO: 7807 - protein, 15 aa, HIV-1
ELYKYKVVKIEPLGV

SEQ ID NO: 7808 - protein, 9 aa, HIV-1
YKYKVVKIE

SEQ ID NO: 7809 - protein, 15 aa, HIV-1
ENFNMWKNDMVEQMH

SEQ ID NO: 7810 - protein, 9 aa, HIV-1
FNMWKNDMV

SEQ ID NO: 7811 - protein, 15 aa, HIV-1
ENFNMWKNDMVEQMH

SEQ ID NO: 7812 - protein, 9 aa, HIV-1
WKNDMVEQM

SEQ ID NO: 7813 - protein, 15 aa, HIV-1
EPIPIHYCAPAGFAI

SEQ ID NO: 7814 - protein, 9 aa, HIV-1
HYCAPAGFA

SEQ ID NO: 7815 - protein, 15 aa, HIV-1
EPLGVAPTKAKRRVV

SEQ ID NO: 7816 - protein, 9 aa, HIV-1
VAPTKAKRR

SEQ ID NO: 7817 - protein, 15 aa, HIV-1
EQELLELDKWASLWN

SEQ ID NO: 7818 - protein, 9 aa, HIV-1
LLELDKWAS

SEQ ID NO: 7819 - protein, 15 aa, HIV-1
EQFGNNKTIIFKQSS

SEQ ID NO: 7820 - protein, 9 aa, HIV-1
FGNNKTIIF

SEQ ID NO: 7821 - protein, 15 aa, HIV-1
EQIWNHTTWMEWDRE

SEQ ID NO: 7822 - protein, 9 aa, HIV-1
IWNHTTWME

SEQ ID NO: 7823 - protein, 15 aa, HIV-1
EVHNVWATHACVPTD

SEQ ID NO: 7824 - protein, 9 aa, HIV-1
WATHACVPT

SEQ ID NO: 7825 - protein, 15 aa, HIV-1
EVVIRSVNFTDNAKT

SEQ ID NO: 7826 - protein, 9 aa, HIV-1
VVIRSVNFT

SEQ ID NO: 7827 - protein, 15 aa, HIV-1
EVVLVNVTENFNMWK

SEQ ID NO: 7828 - protein, 9 aa, HIV-1
LVNVTENFN

SEQ ID NO: 7829 - protein, 15 aa, HIV-1
EVVQGACRAIRHIPR

SEQ ID NO: 7830 - protein, 9 aa, HIV-1
VVQGACRAI

SEQ ID NO: 7831 - protein, 15 aa, HIV-1
EWDREINNYTSLIHS

SEQ ID NO: 7832 - protein, 9 aa, HIV-1
INNYTSLIH

SEQ ID NO: 7833 - protein, 15 aa, HIV-1
EYAFFYKLDIIPIDN

SEQ ID NO: 7834 - protein, 9 aa, HIV-1
YKLDIIPID

SEQ ID NO: 7835 - protein, 15 aa, HIV-1
FAVLSIVNRVRQGYS

SEQ ID NO: 7836 - protein, 9 aa, HIV-1
LSIVNRVRQ

SEQ ID NO: 7837 - protein, 15 aa, HIV-1
FAVLSIVNRVRQGYS

SEQ ID NO: 7838 - protein, 9 aa, HIV-1
VLSIVNRVR

SEQ ID NO: 7839 - protein, 15 aa, HIV-1
FFYKLDIIPIDNDTT

SEQ ID NO: 7840 - protein, 9 aa, HIV-1
YKLDIIPID

SEQ ID NO: 7841 - protein, 15 aa, HIV-1
FGNNKTIIFKQSSGG

SEQ ID NO: 7842 - protein, 9 aa, HIV-1
FGNNKTIIF

SEQ ID NO: 7843 - protein, 15 aa, HIV-1
FIMIVGGLVGLRIVF

SEQ ID NO: 7844 - protein, 9 aa, HIV-1
IMIVGGLVG

SEQ ID NO: 7845 - protein, 15 aa, HIV-1
FIMIVGGLVGLRIVF

SEQ ID NO: 7846 - protein, 9 aa, HIV-1
IVGGLVGLR

SEQ ID NO: 7847 - protein, 15 aa, HIV-1
FIMIVGGLVGLRIVF

SEQ ID NO: 7848 - protein, 9 aa, HIV-1
VGGLVGLRI

SEQ ID NO: 7849 - protein, 15 aa, HIV-1
FLGFLGAAGSTMGAA

SEQ ID NO: 7850 - protein, 9 aa, HIV-1
FLGAAGSTM

SEQ ID NO: 7851 - protein, 15 aa, HIV-1
FLGFLGAAGSTMGAA

SEQ ID NO: 7852 - protein, 9 aa, HIV-1
LGAAGSTMG

SEQ ID NO: 7853 - protein, 15 aa, HIV-1
FLGAAGSTMGAASMT

SEQ ID NO: 7854 - protein, 9 aa, HIV-1
LGAAGSTMG

SEQ ID NO: 7855 - protein, 15 aa, HIV-1
FNGTGPCTNVSTVQC

SEQ ID NO: 7856 - protein, 9 aa, HIV-1
FNGTGPCTN

SEQ ID NO: 7857 - protein, 15 aa, HIV-1
FNISTSIRGKVQKEY

SEQ ID NO: 7858 - protein, 9 aa, HIV-1
FNISTSIRG

SEQ ID NO: 7859 - protein, 15 aa, HIV-1
FNITNWLWYIKLFIM

SEQ ID NO: 7860 - protein, 9 aa, HIV-1
FNITNWLWY

SEQ ID NO: 7861 - protein, 15 aa, HIV-1
FNITNWLWYIKLFIM

SEQ ID NO: 7862 - protein, 9 aa, HIV-1
ITNWLWYIK

SEQ ID NO: 7863 - protein, 15 aa, HIV-1
FNMWKNDMVEQMHED

SEQ ID NO: 7864 - protein, 9 aa, HIV-1
FNMWKNDMV

SEQ ID NO: 7865 - protein, 15 aa, HIV-1
FNMWKNDMVEQMHED

SEQ ID NO: 7866 - protein, 9 aa, HIV-1
WKNDMVEQM

SEQ ID NO: 7867 - protein, 15 aa, HIV-1
FNSTWFNSTWSTEGS

SEQ ID NO: 7868 - protein, 9 aa, HIV-1
FNSTWSTEG

SEQ ID NO: 7869 - protein, 15 aa, HIV-1
FNSTWFNSTWSTEGS

SEQ ID NO: 7870 - protein, 9 aa, HIV-1
WFNSTWSTE

SEQ ID NO: 7871 - protein, 15 aa, HIV-1
FNSTWSTEGSNNTEG

SEQ ID NO: 7872 - protein, 9 aa, HIV-1
FNSTWSTEG

SEQ ID NO: 7873 - protein, 15 aa, HIV-1
FNSTWSTEGSNNTEG

SEQ ID NO: 7874 - protein, 9 aa, HIV-1
WSTEGSNNT

SEQ ID NO: 7875 - protein, 15 aa, HIV-1
FQTHLPTPRGPDRPE

SEQ ID NO: 7876 - protein, 9 aa, HIV-1
FQTHLPTPR

SEQ ID NO: 7877 - protein, 15 aa, HIV-1
FSYHRLRDLLLIVTR

SEQ ID NO: 7878 - protein, 9 aa, HIV-1
LRDLLLIVT

SEQ ID NO: 7879 - protein, 15 aa, HIV-1
FVTIGKIGNMRQAHC

SEQ ID NO: 7880 - protein, 9 aa, HIV-1
IGKIGNMRQ

SEQ ID NO: 7881 - protein, 15 aa, HIV-1
GACRAIRHIPRRIRQ

SEQ ID NO: 7882 - protein, 9 aa, HIV-1
IRHIPRRIR

SEQ ID NO: 7883 - protein, 15 aa, HIV-1
GALFLGFLGAAGSTM

SEQ ID NO: 7884 - protein, 9 aa, HIV-1
FLGFLGAAG

SEQ ID NO: 7885 - protein, 15 aa, HIV-1
GALFLGFLGAAGSTM

SEQ ID NO: 7886 - protein, 9 aa, HIV-1
LGFLGAAGS

SEQ ID NO: 7887 - protein, 15 aa, HIV-1
GCSGKLICTTAVPWN

SEQ ID NO: 7888 - protein, 9 aa, HIV-1
GKLICTTAV

SEQ ID NO: 7889 - protein, 15 aa, HIV-1
GCSGKLICTTAVPWN

SEQ ID NO: 7890 - protein, 9 aa, HIV-1
LICTTAVPW

SEQ ID NO: 7891 - protein, 15 aa, HIV-1
GDMRDNWRSELYKYK

SEQ ID NO: 7892 - protein, 9 aa, HIV-1
RDNWRSELY

SEQ ID NO: 7893 - protein, 15 aa, HIV-1
GEFFYCNSTQLFNST

SEQ ID NO: 7894 - protein, 9 aa, HIV-1
FYCNSTQLF

SEQ ID NO: 7895 - protein, 15 aa, HIV-1
GEIKNCSFNISTSIR

SEQ ID NO: 7896 - protein, 9 aa, HIV-1
IKNCSFNIS

SEQ ID NO: 7897 - protein, 15 aa, HIV-1
GFAILKCNNKTFNGT

SEQ ID NO: 7898 - protein, 9 aa, HIV-1
LKCNNKTFN

SEQ ID NO: 7899 - protein, 15 aa, HIV-1
GFLGAAGSTMGAASM

SEQ ID NO: 7900 - protein, 9 aa, HIV-1
LGAAGSTMG

SEQ ID NO: 7901 - protein, 15 aa, HIV-1
GGEFFYCNSTQLFNS

SEQ ID NO: 7902 - protein, 9 aa, HIV-1
FYCNSTQLF

SEQ ID NO: 7903 - protein, 15 aa, HIV-1
GGLVGLRIVFAVLSI

SEQ ID NO: 7904 - protein, 9 aa, HIV-1
LRIVFAVLS

SEQ ID NO: 7905 - protein, 15 aa, HIV-1
GGLVGLRIVFAVLSI

SEQ ID NO: 7906 - protein, 9 aa, HIV-1
VGLRIVFAV

SEQ ID NO: 7907 - protein, 15 aa, HIV-1
GIGALFLGFLGAAGS

SEQ ID NO: 7908 - protein, 9 aa, HIV-1
FLGFLGAAG

SEQ ID NO: 7909 - protein, 15 aa, HIV-1
GIKQLQARILAVERY

SEQ ID NO: 7910 - protein, 9 aa, HIV-1
IKQLQARIL

SEQ ID NO: 7911 - protein, 15 aa, HIV-1
GIRPVVSTQLLLNGS

SEQ ID NO: 7912 - protein, 9 aa, HIV-1
IRPVVSTQL

SEQ ID NO: 7913 - protein, 15 aa, HIV-1
GIVQQQNNLLRAIEA

SEQ ID NO: 7914 - protein, 9 aa, HIV-1
VQQQNNLLR

SEQ ID NO: 7915 - protein, 15 aa, HIV-1
GKAMYAPPISGQIRC

SEQ ID NO: 7916 - protein, 9 aa, HIV-1
YAPPISGQI

SEQ ID NO: 7917 - protein, 15 aa, HIV-1
GKLICTTAVPWNASW

SEQ ID NO: 7918 - protein, 9 aa, HIV-1
ICTTAVPWN

SEQ ID NO: 7919 - protein, 15 aa, HIV-1
GKLICTTAVPWNASW

SEQ ID NO: 7920 - protein, 9 aa, HIV-1
LICTTAVPW

SEQ ID NO: 7921 - protein, 15 aa, HIV-1
GLRIVFAVLSIVNRV

SEQ ID NO: 7922 - protein, 9 aa, HIV-1
FAVLSIVNR

SEQ ID NO: 7923 - protein, 15 aa, HIV-1
GLRIVFAVLSIVNRV

SEQ ID NO: 7924 - protein, 9 aa, HIV-1
LRIVFAVLS

SEQ ID NO: 7925 - protein, 15 aa, HIV-1
GLVGLRIVFAVLSIV

SEQ ID NO: 7926 - protein, 9 aa, HIV-1
LRIVFAVLS

SEQ ID NO: 7927 - protein, 15 aa, HIV-1
GLVGLRIVFAVLSIV

SEQ ID NO: 7928 - protein, 9 aa, HIV-1
VGLRIVFAV

SEQ ID NO: 7929 - protein, 15 aa, HIV-1
GMLMICSATEKLWVT

SEQ ID NO: 7930 - protein, 9 aa, HIV-1
MICSATEKL

SEQ ID NO: 7931 - protein, 15 aa, HIV-1
GRAFVTIGKIGNMRQ

SEQ ID NO: 7932 - protein, 9 aa, HIV-1
FVTIGKIGN

SEQ ID NO: 7933 - protein, 15 aa, HIV-1
GSLALIWDDLRSLCL

SEQ ID NO: 7934 - protein, 9 aa, HIV-1
LIWDDLRSL

SEQ ID NO: 7935 - protein, 15 aa, HIV-1
GSTMGAASMTLTVQA

SEQ ID NO: 7936 - protein, 9 aa, HIV-1
MGAASMTLT

SEQ ID NO: 7937 - protein, 15 aa, HIV-1
GTMLLGMLMICSATE

SEQ ID NO: 7938 - protein, 9 aa, HIV-1
LLGMLMICS

SEQ ID NO: 7939 - protein, 15 aa, HIV-1
GVAPTKAKRRVVQRE

SEQ ID NO: 7940 - protein, 9 aa, HIV-1
PTKAKRRVV

SEQ ID NO: 7941 - protein, 15 aa, HIV-1
GVAPTKAKRRVVQRE

SEQ ID NO: 7942 - protein, 9 aa, HIV-1
VAPTKAKRR

SEQ ID NO: 7943 - protein, 15 aa, HIV-1
GVPVWKEATTTLFCA

SEQ ID NO: 7944 - protein, 9 aa, HIV-1
WKEATTTLF

SEQ ID NO: 7945 - protein, 15 aa, HIV-1
GWEALKYWWNLLQYW

SEQ ID NO: 7946 - protein, 9 aa, HIV-1
LKYWWNLLQ

SEQ ID NO: 7947 - protein, 15 aa, HIV-1
GWRWGTMLLGMLMIC

SEQ ID NO: 7948 - protein, 9 aa, HIV-1
WGTMLLGML

SEQ ID NO: 7949 - protein, 15 aa, HIV-1
GWRWGTMLLGMLMIC

SEQ ID NO: 7950 - protein, 9 aa, HIV-1
WRWGTMLLG

SEQ ID NO: 7951 - protein, 15 aa, HIV-1
GYSPLSFQTHLPTPR

SEQ ID NO: 7952 - protein, 9 aa, HIV-1
LSFQTHLPT

SEQ ID NO: 7953 - protein, 15 aa, HIV-1
GYSPLSFQTHLPTPR

SEQ ID NO: 7954 - protein, 9 aa, HIV-1
YSPLSFQTH

SEQ ID NO: 7955 - protein, 15 aa, HIV-1
GAAGSTMGAASMTLT

SEQ ID NO: 7956 - protein, 9 aa, HIV-1
STMGAASMT

SEQ ID NO: 7957 - protein, 15 aa, HIV-1
GAAGSTMGAASMTLT

SEQ ID NO: 7958 - protein, 9 aa, HIV-1
TMGAASMTL

SEQ ID NO: 7959 - protein, 15 aa, HIV-1
GAASMTLTVQARQLL

SEQ ID NO: 7960 - protein, 9 aa, HIV-1
TLTVQARQL

SEQ ID NO: 7961 - protein, 15 aa, HIV-1
HACVPTDPNPQEVVL

SEQ ID NO: 7962 - protein, 9 aa, HIV-1
VPTDPNPQE

SEQ ID NO: 7963 - protein, 15 aa, HIV-1
HCNISRAKWNNTLKQ

SEQ ID NO: 7964 - protein, 9 aa, HIV-1
RAKWNNTLK

SEQ ID NO: 7965 - protein, 15 aa, HIV-1
HEDIISLWDQSLKPC

SEQ ID NO: 7966 - protein, 9 aa, HIV-1
IISLWDQSL

SEQ ID NO: 7967 - protein, 15 aa, HIV-1
HEDIISLWDQSLKPC

SEQ ID NO: 7968 - protein, 9 aa, HIV-1
ISLWDQSLK

SEQ ID NO: 7969 - protein, 15 aa, HIV-1
HGIRPVVSTQLLLNG

SEQ ID NO: 7970 - protein, 9 aa, HIV-1
IRPVVSTQL

SEQ ID NO: 7971 - protein, 15 aa, HIV-1
HLLQLTVWGIKQLQA

SEQ ID NO: 7972 - protein, 9 aa, HIV-1
LLQLTVWGI

SEQ ID NO: 7973 - protein, 15 aa, HIV-1
HLWRWGWRWGTMLLG

SEQ ID NO: 7974 - protein, 9 aa, HIV-1
GWRWGTMLL

SEQ ID NO: 7975 - protein, 15 aa, HIV-1
HLWRWGWRWGTMLLG

SEQ ID NO: 7976 - protein, 9 aa, HIV-1
LWRWGWRWG

SEQ ID NO: 7977 - protein, 15 aa, HIV-1
HLWRWGWRWGTMLLG

SEQ ID NO: 7978 - protein, 9 aa, HIV-1
WGWRWGTML

SEQ ID NO: 7979 - protein, 15 aa, HIV-1
HNVWATHACVPTDPN

SEQ ID NO: 7980 - protein, 9 aa, HIV-1
WATHACVPT

SEQ ID NO: 7981 - protein, 15 aa, HIV-1
HRLRDLLLIVTRIVE

SEQ ID NO: 7982 - protein, 9 aa, HIV-1
LLLIVTRIV

SEQ ID NO: 7983 - protein, 15 aa, HIV-1
HRLRDLLLIVTRIVE

SEQ ID NO: 7984 - protein, 9 aa, HIV-1
LRDLLLIVT

SEQ ID NO: 7985 - protein, 15 aa, HIV-1
HTTWMEWDREINNYT

SEQ ID NO: 7986 - protein, 9 aa, HIV-1
MEWDREINN

SEQ ID NO: 7987 - protein, 15 aa, HIV-1
IASKLREQFGNNKTI

SEQ ID NO: 7988 - protein, 9 aa, HIV-1
LREQFGNNK

SEQ ID NO: 7989 - protein, 15 aa, HIV-1
ICTTAVPWNASWSNK

SEQ ID NO: 7990 - protein, 9 aa, HIV-1
VPWNASWSN

SEQ ID NO: 7991 - protein, 15 aa, HIV-1
IEAQQHLLQLTVWGI

SEQ ID NO: 7992 - protein, 9 aa, HIV-1
AQQHLLQLT

SEQ ID NO: 7993 - protein, 15 aa, HIV-1
IEPLGVAPTKAKRRV

SEQ ID NO: 7994 - protein, 9 aa, HIV-1
VAPTKAKRR

SEQ ID NO: 7995 - protein, 15 aa, HIV-1
IEVVQGACRAIRHIP

SEQ ID NO: 7996 - protein, 9 aa, HIV-1
VVQGACRAI

SEQ ID NO: 7997 - protein, 15 aa, HIV-1
IGALFLGFLGAAGST

SEQ ID NO: 7998 - protein, 9 aa, HIV-1
FLGFLGAAG

SEQ ID NO: 7999 - protein, 15 aa, HIV-1
IGALFLGFLGAAGST

SEQ ID NO: 8000 - protein, 9 aa, HIV-1
LGFLGAAGS

SEQ ID NO: 8001 - protein, 15 aa, HIV-1
IHYCAPAGFAILKCN

SEQ ID NO: 8002 - protein, 9 aa, HIV-1
YCAPAGFAI

SEQ ID NO: 8003 - protein, 15 aa, HIV-1
IIFKQSSGGDPEIVT

SEQ ID NO: 8004 - protein, 9 aa, HIV-1
FKQSSGGDP

SEQ ID NO: 8005 - protein, 15 aa, HIV-1
IINMWQKVGKAMYAP

SEQ ID NO: 8006 - protein, 9 aa, HIV-1
INMWQKVGK

SEQ ID NO: 8007 - protein, 15 aa, HIV-1
IINMWQKVGKAMYAP

SEQ ID NO: 8008 - protein, 9 aa, HIV-1
MWQKVGKAM

SEQ ID NO: 8009 - protein, 15 aa, HIV-1
IINMWQKVGKAMYAP

SEQ ID NO: 8010 - protein, 9 aa, HIV-1
WQKVGKAMY

SEQ ID NO: 8011 - protein, 15 aa, HIV-1
IISLWDQSLKPCVKL

SEQ ID NO: 8012 - protein, 9 aa, HIV-1
LWDQSLKPC

SEQ ID NO: 8013 - protein, 15 aa, HIV-1
IIVQLNTSVEINCTR

SEQ ID NO: 8014 - protein, 9 aa, HIV-1
IVQLNTSVE

SEQ ID NO: 8015 - protein, 15 aa, HIV-1
IIVQLNTSVEINCTR

SEQ ID NO: 8016 - protein, 9 aa, HIV-1
VQLNTSVEI

SEQ ID NO: 8017 - protein, 15 aa, HIV-1
IKLFIMIVGGLVGLR

SEQ ID NO: 8018 - protein, 9 aa, HIV-1
FIMIVGGLV

SEQ ID NO: 8019 - protein, 15 aa, HIV-1
IKLFIMIVGGLVGLR

SEQ ID NO: 8020 - protein, 9 aa, HIV-1
IKLFIMIVG

SEQ ID NO: 8021 - protein, 15 aa, HIV-1
IKLFIMIVGGLVGLR

SEQ ID NO: 8022 - protein, 9 aa, HIV-1
IMIVGGLVG

SEQ ID NO: 8023 - protein, 15 aa, HIV-1
IKNCSFNISTSIRGK

SEQ ID NO: 8024 - protein, 9 aa, HIV-1
FNISTSIRG

SEQ ID NO: 8025 - protein, 15 aa, HIV-1
IKNCSFNISTSIRGK

SEQ ID NO: 8026 - protein, 9 aa, HIV-1
IKNCSFNIS

SEQ ID NO: 8027 - protein, 15 aa, HIV-1
IKQIINMWQKVGKAM

SEQ ID NO: 8028 - protein, 9 aa, HIV-1
IINMWQKVG

SEQ ID NO: 8029 - protein, 15 aa, HIV-1
IKQIINMWQKVGKAM

SEQ ID NO: 8030 - protein, 9 aa, HIV-1
INMWQKVGK

SEQ ID NO: 8031 - protein, 15 aa, HIV-1
IKQLQARILAVERYL

SEQ ID NO: 8032 - protein, 9 aa, HIV-1
IKQLQARIL

SEQ ID NO: 8033 - protein, 15 aa, HIV-1
IMEKGEIKNCSFNIS

SEQ ID NO: 8034 - protein, 9 aa, HIV-1
EKGEIKNCS

SEQ ID NO: 8035 - protein, 15 aa, HIV-1
IMIVGGLVGLRIVFA

SEQ ID NO: 8036 - protein, 9 aa, HIV-1
IMIVGGLVG

SEQ ID NO: 8037 - protein, 15 aa, HIV-1
IMIVGGLVGLRIVFA

SEQ ID NO: 8038 - protein, 9 aa, HIV-1
IVGGLVGLR

SEQ ID NO: 8039 - protein, 15 aa, HIV-1
IMIVGGLVGLRIVFA

SEQ ID NO: 8040 - protein, 9 aa, HIV-1
VGGLVGLRI

SEQ ID NO: 8041 - protein, 15 aa, HIV-1
INCTRPNNNTRKRIR

SEQ ID NO: 8042 - protein, 9 aa, HIV-1
PNNNTRKRI

SEQ ID NO: 8043 - protein, 15 aa, HIV-1
INCTRPNNNTRKRIR

SEQ ID NO: 8044 - protein, 9 aa, HIV-1
TRPNNNTRK

SEQ ID NO: 8045 - protein, 15 aa, HIV-1
INMWQKVGKAMYAPP

SEQ ID NO: 8046 - protein, 9 aa, HIV-1
MWQKVGKAM

SEQ ID NO: 8047 - protein, 15 aa, HIV-1
INMWQKVGKAMYAPP

SEQ ID NO: 8048 - protein, 9 aa, HIV-1
WQKVGKAMY

SEQ ID NO: 8049 - protein, 15 aa, HIV-1
INNYTSLIHSLIEES

SEQ ID NO: 8050 - protein, 9 aa, HIV-1
YTSLIHSLI

SEQ ID NO: 8051 - protein, 15 aa, HIV-1
IPIHYCAPAGFAILK

SEQ ID NO: 8052 - protein, 9 aa, HIV-1
YCAPAGFAI

SEQ ID NO: 8053 - protein, 15 aa, HIV-1
IQRGPGRAFVTIGKI

SEQ ID NO: 8054 - protein, 9 aa, HIV-1
IQRGPGRAF

SEQ ID NO: 8055 - protein, 15 aa, HIV-1
IRCSSNITGLLLTRD

SEQ ID NO: 8056 - protein, 9 aa, HIV-1
IRCSSNITG

SEQ ID NO: 8057 - protein, 15 aa, HIV-1
IRIQRGPGRAFVTIG

SEQ ID NO: 8058 - protein, 9 aa, HIV-1
IQRGPGRAF

SEQ ID NO: 8059 - protein, 15 aa, HIV-1
IRIQRGPGRAFVTIG

SEQ ID NO: 8060 - protein, 9 aa, HIV-1
IRIQRGPGR

SEQ ID NO: 8061 - protein, 15 aa, HIV-1
IRLVNGSLALIWDDL

SEQ ID NO: 8062 - protein, 9 aa, HIV-1
IRLVNGSLA

SEQ ID NO: 8063 - protein, 15 aa, HIV-1
IRLVNGSLALIWDDL

SEQ ID NO: 8064 - protein, 9 aa, HIV-1
LVNGSLALI

SEQ ID NO: 8065 - protein, 15 aa, HIV-1
IRPVVSTQLLLNGSL

SEQ ID NO: 8066 - protein, 9 aa, HIV-1
IRPVVSTQL

SEQ ID NO: 8067 - protein, 15 aa, HIV-1
ISLWDQSLKPCVKLT

SEQ ID NO: 8068 - protein, 9 aa, HIV-1
LWDQSLKPC

SEQ ID NO: 8069 - protein, 15 aa, HIV-1
ISRAKWNNTLKQIAS

SEQ ID NO: 8070 - protein, 9 aa, HIV-1
RAKWNNTLK

SEQ ID NO: 8071 - protein, 15 aa, HIV-1
ISRAKWNNTLKQIAS

SEQ ID NO: 8072 - protein, 9 aa, HIV-1
WNNTLKQIA

SEQ ID NO: 8073 - protein, 15 aa, HIV-1
ITGLLLTRDGGNSNN

SEQ ID NO: 8074 - protein, 9 aa, HIV-1
ITGLLLTRD

SEQ ID NO: 8075 - protein, 15 aa, HIV-1
ITNWLWYIKLFIMIV

SEQ ID NO: 8076 - protein, 9 aa, HIV-1
ITNWLWYIK

SEQ ID NO: 8077 - protein, 15 aa, HIV-1
ITNWLWYIKLFIMIV

SEQ ID NO: 8078 - protein, 9 aa, HIV-1
LWYIKLFIM

SEQ ID NO: 8079 - protein, 15 aa, HIV-1
ITNWLWYIKLFIMIV

SEQ ID NO: 8080 - protein, 9 aa, HIV-1
WYIKLFIMI

SEQ ID NO: 8081 - protein, 15 aa, HIV-1
ITQACPKVSFEPIPI

SEQ ID NO: 8082 - protein, 9 aa, HIV-1
ITQACPKVS

SEQ ID NO: 8083 - protein, 15 aa, HIV-1
IVELLGRRGWEALKY

SEQ ID NO: 8084 - protein, 9 aa, HIV-1
IVELLGRRG

SEQ ID NO: 8085 - protein, 15 aa, HIV-1
IVELLGRRGWEALKY

SEQ ID NO: 8086 - protein, 9 aa, HIV-1
LLGRRGWEA

SEQ ID NO: 8087 - protein, 15 aa, HIV-1
IVFAVLSIVNRVRQG

SEQ ID NO: 8088 - protein, 9 aa, HIV-1
FAVLSIVNR

SEQ ID NO: 8089 - protein, 15 aa, HIV-1
IVFAVLSIVNRVRQG

SEQ ID NO: 8090 - protein, 9 aa, HIV-1
LSIVNRVRQ

SEQ ID NO: 8091 - protein, 15 aa, HIV-1
IVFAVLSIVNRVRQG

SEQ ID NO: 8092 - protein, 9 aa, HIV-1
VLSIVNRVR

SEQ ID NO: 8093 - protein, 15 aa, HIV-1
IVGGLVGLRIVFAVL

SEQ ID NO: 8094 - protein, 9 aa, HIV-1
LVGLRIVFA

SEQ ID NO: 8095 - protein, 15 aa, HIV-1
IVGGLVGLRIVFAVL

SEQ ID NO: 8096 - protein, 9 aa, HIV-1
VGLRIVFAV

SEQ ID NO: 8097 - protein, 15 aa, HIV-1
IVNRVRQGYSPLSFQ

SEQ ID NO: 8098 - protein, 9 aa, HIV-1
VRQGYSPLS

SEQ ID NO: 8099 - protein, 15 aa, HIV-1
IVQLNTSVEINCTRP

SEQ ID NO: 8100 - protein, 9 aa, HIV-1
VQLNTSVEI

SEQ ID NO: 8101 - protein, 15 aa, HIV-1
IVQQQNNLLRAIEAQ

SEQ ID NO: 8102 - protein, 9 aa, HIV-1
IVQQQNNLL

SEQ ID NO: 8103 - protein, 15 aa, HIV-1
IVQQQNNLLRAIEAQ

SEQ ID NO: 8104 - protein, 9 aa, HIV-1
VQQQNNLLR

SEQ ID NO: 8105 - protein, 15 aa, HIV-1
IVTRIVELLGRRGWE

SEQ ID NO: 8106 - protein, 9 aa, HIV-1
IVELLGRRG

SEQ ID NO: 8107 - protein, 15 aa, HIV-1
IVTRIVELLGRRGWE

SEQ ID NO: 8108 - protein, 9 aa, HIV-1
TRIVELLGR

SEQ ID NO: 8109 - protein, 15 aa, HIV-1
IWDDLRSLCLFSYHR

SEQ ID NO: 8110 - protein, 9 aa, HIV-1
LRSLCLFSY

SEQ ID NO: 8111 - protein, 15 aa, HIV-1
IWNHTTWMEWDREIN

SEQ ID NO: 8112 - protein, 9 aa, HIV-1
IWNHTTWME

SEQ ID NO: 8113 - protein, 15 aa, HIV-1
KAMYAPPISGQIRCS

SEQ ID NO: 8114 - protein, 9 aa, HIV-1
YAPPISGQI

SEQ ID NO: 8115 - protein, 15 aa, HIV-1
KAYDTEVHNVWATHA

SEQ ID NO: 8116 - protein, 9 aa, HIV-1
TEVHNVWAT

SEQ ID NO: 8117 - protein, 15 aa, HIV-1
KCNNKTFNGTGPCTN

SEQ ID NO: 8118 - protein, 9 aa, HIV-1
TFNGTGPCT

SEQ ID NO: 8119 - protein, 15 aa, HIV-1
KCTDLKNDTNTNSSS

SEQ ID NO: 8120 - protein, 9 aa, HIV-1
LKNDTNTNS

SEQ ID NO: 8121 - protein, 15 aa, HIV-1
KEKYQHLWRWGWRWG

SEQ ID NO: 8122 - protein, 9 aa, HIV-1
QHLWRWGWR

SEQ ID NO: 8123 - protein, 15 aa, HIV-1
KEKYQHLWRWGWRWG

SEQ ID NO: 8124 - protein, 9 aa, HIV-1
YQHLWRWGW

SEQ ID NO: 8125 - protein, 15 aa, HIV-1
KEYAFFYKLDIIPID

SEQ ID NO: 8126 - protein, 9 aa, HIV-1
FYKLDIIPI

SEQ ID NO: 8127 - protein, 15 aa, HIV-1
KEYAFFYKLDIIPID

SEQ ID NO: 8128 - protein, 9 aa, HIV-1
YAFFYKLDI

SEQ ID NO: 8129 - protein, 15 aa, HIV-1
KGEIKNCSFNISTSI

SEQ ID NO: 8130 - protein, 9 aa, HIV-1
IKNCSFNIS

SEQ ID NO: 8131 - protein, 15 aa, HIV-1
KIEPLGVAPTKAKRR

SEQ ID NO: 8132 - protein, 9 aa, HIV-1
LGVAPTKAK

SEQ ID NO: 8133 - protein, 15 aa, HIV-1
KLFIMIVGGLVGLRI

SEQ ID NO: 8134 - protein, 9 aa, HIV-1
IMIVGGLVG

SEQ ID NO: 8135 - protein, 15 aa, HIV-1
KLFIMIVGGLVGLRI

SEQ ID NO: 8136 - protein, 9 aa, HIV-1
IVGGLVGLR

SEQ ID NO: 8137 - protein, 15 aa, HIV-1
KLICTTAVPWNASWS

SEQ ID NO: 8138 - protein, 9 aa, HIV-1
ICTTAVPWN

SEQ ID NO: 8139 - protein, 15 aa, HIV-1
KLICTTAVPWNASWS

SEQ ID NO: 8140 - protein, 9 aa, HIV-1
LICTTAVPW

SEQ ID NO: 8141 - protein, 15 aa, HIV-1
KLREQFGNNKTIIFK

SEQ ID NO: 8142 - protein, 9 aa, HIV-1
FGNNKTIIF

SEQ ID NO: 8143 - protein, 15 aa, HIV-1
KLTSCNTSVITQACP

SEQ ID NO: 8144 - protein, 9 aa, HIV-1
LTSCNTSVI

SEQ ID NO: 8145 - protein, 15 aa, HIV-1
KLWVTVYYGVPVWKE

SEQ ID NO: 8146 - protein, 9 aa, HIV-1
VTVYYGVPV

SEQ ID NO: 8147 - protein, 15 aa, HIV-1
KNCSFNISTSIRGKV

SEQ ID NO: 8148 - protein, 9 aa, HIV-1
FNISTSIRG

SEQ ID NO: 8149 - protein, 15 aa, HIV-1
KNSAVSLLNATAIAV

SEQ ID NO: 8150 - protein, 9 aa, HIV-1
VSLLNATAI

SEQ ID NO: 8151 - protein, 15 aa, HIV-1
KPCVKLTPLCVSLKC

SEQ ID NO: 8152 - protein, 9 aa, HIV-1
LTPLCVSLK

SEQ ID NO: 8153 - protein, 15 aa, HIV-1
KQIINMWQKVGKAMY

SEQ ID NO: 8154 - protein, 9 aa, HIV-1
INMWQKVGK

SEQ ID NO: 8155 - protein, 15 aa, HIV-1
KQIINMWQKVGKAMY

SEQ ID NO: 8156 - protein, 9 aa, HIV-1
MWQKVGKAM

SEQ ID NO: 8157 - protein, 15 aa, HIV-1
KRAVGIGALFLGFLG

SEQ ID NO: 8158 - protein, 9 aa, HIV-1
VGIGALFLG

SEQ ID NO: 8159 - protein, 15 aa, HIV-1
KRIRIQRGPGRAFVT

SEQ ID NO: 8160 - protein, 9 aa, HIV-1
IQRGPGRAF

SEQ ID NO: 8161 - protein, 15 aa, HIV-1
KRIRIQRGPGRAFVT

SEQ ID NO: 8162 - protein, 9 aa, HIV-1
IRIQRGPGR

SEQ ID NO: 8163 - protein, 15 aa, HIV-1
KSLEQIWNHTTWMEW

SEQ ID NO: 8164 - protein, 9 aa, HIV-1
IWNHTTWME

SEQ ID NO: 8165 - protein, 15 aa, HIV-1
KTFNGTGPCTNVSTV

SEQ ID NO: 8166 - protein, 9 aa, HIV-1
FNGTGPCTN

SEQ ID NO: 8167 - protein, 15 aa, HIV-1
KTIIFKQSSGGDPEI

SEQ ID NO: 8168 - protein, 9 aa, HIV-1
FKQSSGGDP

SEQ ID NO: 8169 - protein, 15 aa, HIV-1
KTIIVQLNTSVEINC

SEQ ID NO: 8170 - protein, 9 aa, HIV-1
IVQLNTSVE

SEQ ID NO: 8171 - protein, 15 aa, HIV-1
KTIIVQLNTSVEINC

SEQ ID NO: 8172 - protein, 9 aa, HIV-1
VQLNTSVEI

SEQ ID NO: 8173 - protein, 15 aa, HIV-1
KVGKAMYAPPISGQI

SEQ ID NO: 8174 - protein, 9 aa, HIV-1
GKAMYAPPI

SEQ ID NO: 8175 - protein, 15 aa, HIV-1
KVVKIEPLGVAPTKA

SEQ ID NO: 8176 - protein, 9 aa, HIV-1
IEPLGVAPT

SEQ ID NO: 8177 - protein, 15 aa, HIV-1
KWASLWNWFNITNWL

SEQ ID NO: 8178 - protein, 9 aa, HIV-1
WASLWNWFN

SEQ ID NO: 8179 - protein, 15 aa, HIV-1
KWNNTLKQIASKLRE

SEQ ID NO: 8180 - protein, 9 aa, HIV-1
LKQIASKLR

SEQ ID NO: 8181 - protein, 15 aa, HIV-1
KYKVVKIEPLGVAPT

SEQ ID NO: 8182 - protein, 9 aa, HIV-1
VKIEPLGVA

SEQ ID NO: 8183 - protein, 15 aa, HIV-1
KYKVVKIEPLGVAPT

SEQ ID NO: 8184 - protein, 9 aa, HIV-1
VVKIEPLGV

SEQ ID NO: 8185 - protein, 15 aa, HIV-1
KYQHLWRWGWRWGTM

SEQ ID NO: 8186 - protein, 9 aa, HIV-1
LWRWGWRWG

SEQ ID NO: 8187 - protein, 15 aa, HIV-1
KYQHLWRWGWRWGTM

SEQ ID NO: 8188 - protein, 9 aa, HIV-1
QHLWRWGWR

SEQ ID NO: 8189 - protein, 15 aa, HIV-1
KYWWNLLQYWSQELK

SEQ ID NO: 8190 - protein, 9 aa, HIV-1
KYWWNLLQY

SEQ ID NO: 8191 - protein, 15 aa, HIV-1
KYWWNLLQYWSQELK

SEQ ID NO: 8192 - protein, 9 aa, HIV-1
WNLLQYWSQ

SEQ ID NO: 8193 - protein, 15 aa, HIV-1
KYWWNLLQYWSQELK

SEQ ID NO: 8194 - protein, 9 aa, HIV-1
YWWNLLQYW

SEQ ID NO: 8195 - protein, 15 aa, HIV-1
LAEEEVVIRSVNFTD

SEQ ID NO: 8196 - protein, 9 aa, HIV-1
VVIRSVNFT

SEQ ID NO: 8197 - protein, 15 aa, HIV-1
LALIWDDLRSLCLFS

SEQ ID NO: 8198 - protein, 9 aa, HIV-1
WDDLRSLCL

SEQ ID NO: 8199 - protein, 15 aa, HIV-1
LCLFSYHRLRDLLLI

SEQ ID NO: 8200 - protein, 9 aa, HIV-1
YHRLRDLLL

SEQ ID NO: 8201 - protein, 15 aa, HIV-1
LDKWASLWNWFNITN

SEQ ID NO: 8202 - protein, 9 aa, HIV-1
WASLWNWFN

SEQ ID NO: 8203 - protein, 15 aa, HIV-1
LELDKWASLWNWFNI

SEQ ID NO: 8204 - protein, 9 aa, HIV-1
WASLWNWFN

SEQ ID NO: 8205 - protein, 15 aa, HIV-1
LEQIWNHTTWMEWDR

SEQ ID NO: 8206 - protein, 9 aa, HIV-1
IWNHTTWME

SEQ ID NO: 8207 - protein, 15 aa, HIV-1
LEQIWNHTTWMEWDR

SEQ ID NO: 8208 - protein, 9 aa, HIV-1
WNHTTWMEW

SEQ ID NO: 8209 - protein, 15 aa, HIV-1
LFIMIVGGLVGLRIV

SEQ ID NO: 8210 - protein, 9 aa, HIV-1
IMIVGGLVG

SEQ ID NO: 8211 - protein, 15 aa, HIV-1
LFIMIVGGLVGLRIV

SEQ ID NO: 8212 - protein, 9 aa, HIV-1
VGGLVGLRI

SEQ ID NO: 8213 - protein, 15 aa, HIV-1
LFLGFLGAAGSTMGA

SEQ ID NO: 8214 - protein, 9 aa, HIV-1
FLGFLGAAG

SEQ ID NO: 8215 - protein, 15 aa, HIV-1
LFLGFLGAAGSTMGA

SEQ ID NO: 8216 - protein, 9 aa, HIV-1
FLGAAGSTM

SEQ ID NO: 8217 - protein, 15 aa, HIV-1
LFLGFLGAAGSTMGA

SEQ ID NO: 8218 - protein, 9 aa, HIV-1
LGAAGSTMG

SEQ ID NO: 8219 - protein, 15 aa, HIV-1
LFNSTWFNSTWSTEG

SEQ ID NO: 8220 - protein, 9 aa, HIV-1
FNSTWFNST

SEQ ID NO: 8221 - protein, 15 aa, HIV-1
LFNSTWFNSTWSTEG

SEQ ID NO: 8222 - protein, 9 aa, HIV-1
LFNSTWFNS

SEQ ID NO: 8223 - protein, 15 aa, HIV-1
LFNSTWFNSTWSTEG

SEQ ID NO: 8224 - protein, 9 aa, HIV-1
STWFNSTWS

SEQ ID NO: 8225 - protein, 15 aa, HIV-1
LFNSTWFNSTWSTEG

SEQ ID NO: 8226 - protein, 9 aa, HIV-1
TWFNSTWST

SEQ ID NO: 8227 - protein, 15 aa, HIV-1
LFNSTWFNSTWSTEG

SEQ ID NO: 8228 - protein, 9 aa, HIV-1
WFNSTWSTE

SEQ ID NO: 8229 - protein, 15 aa, HIV-1
LFSYHRLRDLLLIVT

SEQ ID NO: 8230 - protein, 9 aa, HIV-1
YHRLRDLLL

SEQ ID NO: 8231 - protein, 15 aa, HIV-1
LGFLGAAGSTMGAAS

SEQ ID NO: 8232 - protein, 9 aa, HIV-1
LGAAGSTMG

SEQ ID NO: 8233 - protein, 15 aa, HIV-1
LGMLMICSATEKLWV

SEQ ID NO: 8234 - protein, 9 aa, HIV-1
MLMICSATE

SEQ ID NO: 8235 - protein, 15 aa, HIV-1
LGVAPTKAKRRVVQR

SEQ ID NO: 8236 - protein, 9 aa, HIV-1
PTKAKRRVV

SEQ ID NO: 8237 - protein, 15 aa, HIV-1
LGVAPTKAKRRVVQR

SEQ ID NO: 8238 - protein, 9 aa, HIV-1
VAPTKAKRR

SEQ ID NO: 8239 - protein, 15 aa, HIV-1
LGAAGSTMGAASMTL

SEQ ID NO: 8240 - protein, 9 aa, HIV-1
LGAAGSTMG

SEQ ID NO: 8241 - protein, 15 aa, HIV-1
LICTTAVPWNASWSN

SEQ ID NO: 8242 - protein, 9 aa, HIV-1
LICTTAVPW

SEQ ID NO: 8243 - protein, 15 aa, HIV-1
LICTTAVPWNASWSN

SEQ ID NO: 8244 - protein, 9 aa, HIV-1
TTAVPWNAS

SEQ ID NO: 8245 - protein, 15 aa, HIV-1
LIVTRIVELLGRRGW

SEQ ID NO: 8246 - protein, 9 aa, HIV-1
IVELLGRRG

SEQ ID NO: 8247 - protein, 15 aa, HIV-1
LIVTRIVELLGRRGW

SEQ ID NO: 8248 - protein, 9 aa, HIV-1
TRIVELLGR

SEQ ID NO: 8249 - protein, 15 aa, HIV-1
LIWDDLRSLCLFSYH

SEQ ID NO: 8250 - protein, 9 aa, HIV-1
WDDLRSLCL

SEQ ID NO: 8251 - protein, 15 aa, HIV-1
LKCTDLKNDTNTNSS

SEQ ID NO: 8252 - protein, 9 aa, HIV-1
LKNDTNTNS

SEQ ID NO: 8253 - protein, 15 aa, HIV-1
LKNSAVSLLNATAIA

SEQ ID NO: 8254 - protein, 9 aa, HIV-1
LKNSAVSLL

SEQ ID NO: 8255 - protein, 15 aa, HIV-1
LKPCVKLTPLCVSLK

SEQ ID NO: 8256 - protein, 9 aa, HIV-1
CVKLTPLCV

SEQ ID NO: 8257 - protein, 15 aa, HIV-1
LKQIASKLREQFGNN

SEQ ID NO: 8258 - protein, 9 aa, HIV-1
LKQIASKLR

SEQ ID NO: 8259 - protein, 15 aa, HIV-1
LKYWWNLLQYWSQEL

SEQ ID NO: 8260 - protein, 9 aa, HIV-1
LKYWWNLLQ

SEQ ID NO: 8261 - protein, 15 aa, HIV-1
LKYWWNLLQYWSQEL

SEQ ID NO: 8262 - protein, 9 aa, HIV-1
YWWNLLQYW

SEQ ID NO: 8263 - protein, 15 aa, HIV-1
LLELDKWASLWNWFN

SEQ ID NO: 8264 - protein, 9 aa, HIV-1
LDKWASLWN

SEQ ID NO: 8265 - protein, 15 aa, HIV-1
LLGMLMICSATEKLW

SEQ ID NO: 8266 - protein, 9 aa, HIV-1
LLGMLMICS

SEQ ID NO: 8267 - protein, 15 aa, HIV-1
LLIVTRIVELLGRRG

SEQ ID NO: 8268 - protein, 9 aa, HIV-1
IVTRIVELL

SEQ ID NO: 8269 - protein, 15 aa, HIV-1
LLIVTRIVELLGRRG

SEQ ID NO: 8270 - protein, 9 aa, HIV-1
LLIVTRIVE

SEQ ID NO: 8271 - protein, 15 aa, HIV-1
LLIVTRIVELLGRRG

SEQ ID NO: 8272 - protein, 9 aa, HIV-1
TRIVELLGR

SEQ ID NO: 8273 - protein, 15 aa, HIV-1
LLLIVTRIVELLGRR

SEQ ID NO: 8274 - protein, 9 aa, HIV-1
IVTRIVELL

SEQ ID NO: 8275 - protein, 15 aa, HIV-1
LLLIVTRIVELLGRR

SEQ ID NO: 8276 - protein, 9 aa, HIV-1
LIVTRIVEL

SEQ ID NO: 8277 - protein, 15 aa, HIV-1
LLLIVTRIVELLGRR

SEQ ID NO: 8278 - protein, 9 aa, HIV-1
LLIVTRIVE

SEQ ID NO: 8279 - protein, 15 aa, HIV-1
LLLIVTRIVELLGRR

SEQ ID NO: 8280 - protein, 9 aa, HIV-1
TRIVELLGR

SEQ ID NO: 8281 - protein, 15 aa, HIV-1
LLNATAIAVAEGTDR

SEQ ID NO: 8282 - protein, 9 aa, HIV-1
LLNATAIAV

SEQ ID NO: 8283 - protein, 15 aa, HIV-1
LLQLTVWGIKQLQAR

SEQ ID NO: 8284 - protein, 9 aa, HIV-1
LLQLTVWGI

SEQ ID NO: 8285 - protein, 15 aa, HIV-1
LLQYWSQELKNSAVS

SEQ ID NO: 8286 - protein, 9 aa, HIV-1
WSQELKNSA

SEQ ID NO: 8287 - protein, 15 aa, HIV-1
LLQYWSQELKNSAVS

SEQ ID NO: 8288 - protein, 9 aa, HIV-1
YWSQELKNS

SEQ ID NO: 8289 - protein, 15 aa, HIV-1
LLRAIEAQQHLLQLT

SEQ ID NO: 8290 - protein, 9 aa, HIV-1
LRAIEAQQH

SEQ ID NO: 8291 - protein, 15 aa, HIV-1
LLSGIVQQQNNLLRA

SEQ ID NO: 8292 - protein, 9 aa, HIV-1
IVQQQNNLL

SEQ ID NO: 8293 - protein, 15 aa, HIV-1
LLSGIVQQQNNLLRA

SEQ ID NO: 8294 - protein, 9 aa, HIV-1
VQQQNNLLR

SEQ ID NO: 8295 - protein, 15 aa, HIV-1
LNATAIAVAEGTDRV

SEQ ID NO: 8296 - protein, 9 aa, HIV-1
LNATAIAVA

SEQ ID NO: 8297 - protein, 15 aa, HIV-1
LQLTVWGIKQLQARI

SEQ ID NO: 8298 - protein, 9 aa, HIV-1
WGIKQLQAR

SEQ ID NO: 8299 - protein, 15 aa, HIV-1
LQYWSQELKNSAVSL

SEQ ID NO: 8300 - protein, 9 aa, HIV-1
YWSQELKNS

SEQ ID NO: 8301 - protein, 15 aa, HIV-1
LRAIEAQQHLLQLTV

SEQ ID NO: 8302 - protein, 9 aa, HIV-1
LRAIEAQQH

SEQ ID NO: 8303 - protein, 15 aa, HIV-1
LRDLLLIVTRIVELL

SEQ ID NO: 8304 - protein, 9 aa, HIV-1
LIVTRIVEL

SEQ ID NO: 8305 - protein, 15 aa, HIV-1
LRDLLLIVTRIVELL

SEQ ID NO: 8306 - protein, 9 aa, HIV-1
LLIVTRIVE

SEQ ID NO: 8307 - protein, 15 aa, HIV-1
LRDLLLIVTRIVELL

SEQ ID NO: 8308 - protein, 9 aa, HIV-1
LRDLLLIVT

SEQ ID NO: 8309 - protein, 15 aa, HIV-1
LREQFGNNKTIIFKQ

SEQ ID NO: 8310 - protein, 9 aa, HIV-1
FGNNKTIIF

SEQ ID NO: 8311 - protein, 15 aa, HIV-1
LRIVFAVLSIVNRVR

SEQ ID NO: 8312 - protein, 9 aa, HIV-1
FAVLSIVNR

SEQ ID NO: 8313 - protein, 15 aa, HIV-1
LRIVFAVLSIVNRVR

SEQ ID NO: 8314 - protein, 9 aa, HIV-1
LRIVFAVLS

SEQ ID NO: 8315 - protein, 15 aa, HIV-1
LRIVFAVLSIVNRVR

SEQ ID NO: 8316 - protein, 9 aa, HIV-1
VFAVLSIVN

SEQ ID NO: 8317 - protein, 15 aa, HIV-1
LRSLCLFSYHRLRDL

SEQ ID NO: 8318 - protein, 9 aa, HIV-1
LRSLCLFSY

SEQ ID NO: 8319 - protein, 15 aa, HIV-1
LSFQTHLPTPRGPDR

SEQ ID NO: 8320 - protein, 9 aa, HIV-1
FQTHLPTPR

SEQ ID NO: 8321 - protein, 15 aa, HIV-1
LSFQTHLPTPRGPDR

SEQ ID NO: 8322 - protein, 9 aa, HIV-1
QTHLPTPRG

SEQ ID NO: 8323 - protein, 15 aa, HIV-1
LSGIVQQQNNLLRAI

SEQ ID NO: 8324 - protein, 9 aa, HIV-1
IVQQQNNLL

SEQ ID NO: 8325 - protein, 15 aa, HIV-1
LSGIVQQQNNLLRAI

SEQ ID NO: 8326 - protein, 9 aa, HIV-1
VQQQNNLLR

SEQ ID NO: 8327 - protein, 15 aa, HIV-1
LSIVNRVRQGYSPLS

SEQ ID NO: 8328 - protein, 9 aa, HIV-1
IVNRVRQGY

SEQ ID NO: 8329 - protein, 15 aa, HIV-1
LSIVNRVRQGYSPLS

SEQ ID NO: 8330 - protein, 9 aa, HIV-1
RVRQGYSPL

SEQ ID NO: 8331 - protein, 15 aa, HIV-1
LSIVNRVRQGYSPLS

SEQ ID NO: 8332 - protein, 9 aa, HIV-1
VNRVRQGYS

SEQ ID NO: 8333 - protein, 15 aa, HIV-1
LTSCNTSVITQACPK

SEQ ID NO: 8334 - protein, 9 aa, HIV-1
LTSCNTSVI

SEQ ID NO: 8335 - protein, 15 aa, HIV-1
LTVQARQLLSGIVQQ

SEQ ID NO: 8336 - protein, 9 aa, HIV-1
LTVQARQLL

SEQ ID NO: 8337 - protein, 15 aa, HIV-1
LTVQARQLLSGIVQQ

SEQ ID NO: 8338 - protein, 9 aa, HIV-1
VQARQLLSG

SEQ ID NO: 8339 - protein, 15 aa, HIV-1
LTVWGIKQLQARILA

SEQ ID NO: 8340 - protein, 9 aa, HIV-1
IKQLQARIL

SEQ ID NO: 8341 - protein, 15 aa, HIV-1
LTVWGIKQLQARILA

SEQ ID NO: 8342 - protein, 9 aa, HIV-1
WGIKQLQAR

SEQ ID NO: 8343 - protein, 15 aa, HIV-1
LVGLRIVFAVLSIVN

SEQ ID NO: 8344 - protein, 9 aa, HIV-1
LRIVFAVLS

SEQ ID NO: 8345 - protein, 15 aa, HIV-1
LVNGSLALIWDDLRS

SEQ ID NO: 8346 - protein, 9 aa, HIV-1
LVNGSLALI

SEQ ID NO: 8347 - protein, 15 aa, HIV-1
LWNWFNITNWLWYIK

SEQ ID NO: 8348 - protein, 9 aa, HIV-1
FNITNWLWY

SEQ ID NO: 8349 - protein, 15 aa, HIV-1
LWNWFNITNWLWYIK

SEQ ID NO: 8350 - protein, 9 aa, HIV-1
WFNITNWLW

SEQ ID NO: 8351 - protein, 15 aa, HIV-1
LWRWGWRWGTMLLGM

SEQ ID NO: 8352 - protein, 9 aa, HIV-1
GWRWGTMLL

SEQ ID NO: 8353 - protein, 15 aa, HIV-1
LWRWGWRWGTMLLGM

SEQ ID NO: 8354 - protein, 9 aa, HIV-1
LWRWGWRWG

SEQ ID NO: 8355 - protein, 15 aa, HIV-1
LWRWGWRWGTMLLGM

SEQ ID NO: 8356 - protein, 9 aa, HIV-1
WRWGTMLLG

SEQ ID NO: 8357 - protein, 15 aa, HIV-1
LWVTVYYGVPVWKEA

SEQ ID NO: 8358 - protein, 9 aa, HIV-1
YYGVPVWKE

SEQ ID NO: 8359 - protein, 15 aa, HIV-1
LWYIKLFIMIVGGLV

SEQ ID NO: 8360 - protein, 9 aa, HIV-1
IKLFIMIVG

SEQ ID NO: 8361 - protein, 15 aa, HIV-1
LWYIKLFIMIVGGLV

SEQ ID NO: 8362 - protein, 9 aa, HIV-1
YIKLFIMIV

SEQ ID NO: 8363 - protein, 15 aa, HIV-1
LYKYKVVKIEPLGVA

SEQ ID NO: 8364 - protein, 9 aa, HIV-1
VVKIEPLGV

SEQ ID NO: 8365 - protein, 15 aa, HIV-1
LYKYKVVKIEPLGVA

SEQ ID NO: 8366 - protein, 9 aa, HIV-1
YKVVKIEPL

SEQ ID NO: 8367 - protein, 15 aa, HIV-1
MEKGEIKNCSFNIST

SEQ ID NO: 8368 - protein, 9 aa, HIV-1
IKNCSFNIS

SEQ ID NO: 8369 - protein, 15 aa, HIV-1
MEWDREINNYTSLIH

SEQ ID NO: 8370 - protein, 9 aa, HIV-1
EINNYTSLI

SEQ ID NO: 8371 - protein, 15 aa, HIV-1
MEWDREINNYTSLIH

SEQ ID NO: 8372 - protein, 9 aa, HIV-1
MEWDREINN

SEQ ID NO: 8373 - protein, 15 aa, HIV-1
MGAASMTLTVQARQL

SEQ ID NO: 8374 - protein, 9 aa, HIV-1
MGAASMTLT

SEQ ID NO: 8375 - protein, 15 aa, HIV-1
MHEDIISLWDQSLKP

SEQ ID NO: 8376 - protein, 9 aa, HIV-1
ISLWDQSLK

SEQ ID NO: 8377 - protein, 15 aa, HIV-1
MIVGGLVGLRIVFAV

SEQ ID NO: 8378 - protein, 9 aa, HIV-1
IVGGLVGLR

SEQ ID NO: 8379 - protein, 15 aa, HIV-1
MIVGGLVGLRIVFAV

SEQ ID NO: 8380 - protein, 9 aa, HIV-1
LVGLRIVFA

SEQ ID NO: 8381 - protein, 15 aa, HIV-1
MIVGGLVGLRIVFAV

SEQ ID NO: 8382 - protein, 9 aa, HIV-1
VGGLVGLRI

SEQ ID NO: 8383 - protein, 15 aa, HIV-1
MLLGMLMICSATEKL

SEQ ID NO: 8384 - protein, 9 aa, HIV-1
LLGMLMICS

SEQ ID NO: 8385 - protein, 15 aa, HIV-1
MRDNWRSELYKYKVV

SEQ ID NO: 8386 - protein, 9 aa, HIV-1
WRSELYKYK

SEQ ID NO: 8387 - protein, 15 aa, HIV-1
MRVKEKYQHLWRWGW

SEQ ID NO: 8388 - protein, 9 aa, HIV-1
MRVKEKYQH

SEQ ID NO: 8389 - protein, 15 aa, HIV-1
MTLTVQARQLLSGIV

SEQ ID NO: 8390 - protein, 9 aa, HIV-1
LTVQARQLL

SEQ ID NO: 8391 - protein, 15 aa, HIV-1
MTLTVQARQLLSGIV

SEQ ID NO: 8392 - protein, 9 aa, HIV-1
VQARQLLSG

SEQ ID NO: 8393 - protein, 15 aa, HIV-1
MWQKVGKAMYAPPIS

SEQ ID NO: 8394 - protein, 9 aa, HIV-1
QKVGKAMYA

SEQ ID NO: 8395 - protein, 15 aa, HIV-1
NAKTIIVQLNTSVEI

SEQ ID NO: 8396 - protein, 9 aa, HIV-1
IIVQLNTSV

SEQ ID NO: 8397 - protein, 15 aa, HIV-1
NAKTIIVQLNTSVEI

SEQ ID NO: 8398 - protein, 9 aa, HIV-1
IVQLNTSVE

SEQ ID NO: 8399 - protein, 15 aa, HIV-1
NATAIAVAEGTDRVI

SEQ ID NO: 8400 - protein, 9 aa, HIV-1
TAIAVAEGT

SEQ ID NO: 8401 - protein, 15 aa, HIV-1
NCSFNISTSIRGKVQ

SEQ ID NO: 8402 - protein, 9 aa, HIV-1
FNISTSIRG

SEQ ID NO: 8403 - protein, 15 aa, HIV-1
NCTRPNNNTRKRIRI

SEQ ID NO: 8404 - protein, 9 aa, HIV-1
PNNNTRKRI

SEQ ID NO: 8405 - protein, 15 aa, HIV-1
NCTRPNNNTRKRIRI

SEQ ID NO: 8406 - protein, 9 aa, HIV-1
TRPNNNTRK

SEQ ID NO: 8407 - protein, 15 aa, HIV-1
NFNMWKNDMVEQMHE

SEQ ID NO: 8408 - protein, 9 aa, HIV-1
FNMWKNDMV

SEQ ID NO: 8409 - protein, 15 aa, HIV-1
NFNMWKNDMVEQMHE

SEQ ID NO: 8410 - protein, 9 aa, HIV-1
WKNDMVEQM

SEQ ID NO: 8411 - protein, 15 aa, HIV-1
NHTTWMEWDREINNY

SEQ ID NO: 8412 - protein, 9 aa, HIV-1
MEWDREINN

SEQ ID NO: 8413 - protein, 15 aa, HIV-1
NISRAKWNNTLKQIA

SEQ ID NO: 8414 - protein, 9 aa, HIV-1
AKWNNTLKQ

SEQ ID NO: 8415 - protein, 15 aa, HIV-1
NISRAKWNNTLKQIA

SEQ ID NO: 8416 - protein, 9 aa, HIV-1
RAKWNNTLK

SEQ ID NO: 8417 - protein, 15 aa, HIV-1
NITGLLLTRDGGNSN

SEQ ID NO: 8418 - protein, 9 aa, HIV-1
ITGLLLTRD

SEQ ID NO: 8419 - protein, 15 aa, HIV-1
NITNWLWYIKLFIMI

SEQ ID NO: 8420 - protein, 9 aa, HIV-1
ITNWLWYIK

SEQ ID NO: 8421 - protein, 15 aa, HIV-1
NKSLEQIWNHTTWME

SEQ ID NO: 8422 - protein, 9 aa, HIV-1
LEQIWNHTT

SEQ ID NO: 8423 - protein, 15 aa, HIV-1
NKTFNGTGPCTNVST

SEQ ID NO: 8424 - protein, 9 aa, HIV-1
FNGTGPCTN

SEQ ID NO: 8425 - protein, 15 aa, HIV-1
NKTIIFKQSSGGDPE

SEQ ID NO: 8426 - protein, 9 aa, HIV-1
FKQSSGGDP

SEQ ID NO: 8427 - protein, 15 aa, HIV-1
NLLQYWSQELKNSAV

SEQ ID NO: 8428 - protein, 9 aa, HIV-1
LQYWSQELK

SEQ ID NO: 8429 - protein, 15 aa, HIV-1
NLLQYWSQELKNSAV

SEQ ID NO: 8430 - protein, 9 aa, HIV-1
YWSQELKNS

SEQ ID NO: 8431 - protein, 15 aa, HIV-1
NLLRAIEAQQHLLQL

SEQ ID NO: 8432 - protein, 9 aa, HIV-1
LRAIEAQQH

SEQ ID NO: 8433 - protein, 15 aa, HIV-1
NMWQKVGKAMYAPPI

SEQ ID NO: 8434 - protein, 9 aa, HIV-1
QKVGKAMYA

SEQ ID NO: 8435 - protein, 15 aa, HIV-1
NMWQKVGKAMYAPPI

SEQ ID NO: 8436 - protein, 9 aa, HIV-1
WQKVGKAMY

SEQ ID NO: 8437 - protein, 15 aa, HIV-1
NNKTFNGTGPCTNVS

SEQ ID NO: 8438 - protein, 9 aa, HIV-1
FNGTGPCTN

SEQ ID NO: 8439 - protein, 15 aa, HIV-1
NNKTIIFKQSSGGDP

SEQ ID NO: 8440 - protein, 9 aa, HIV-1
IFKQSSGGD

SEQ ID NO: 8441 - protein, 15 aa, HIV-1
NNLLRAIEAQQHLLQ

SEQ ID NO: 8442 - protein, 9 aa, HIV-1
LRAIEAQQH

SEQ ID NO: 8443 - protein, 15 aa, HIV-1
NNTLKQIASKLREQF

SEQ ID NO: 8444 - protein, 9 aa, HIV-1
LKQIASKLR

SEQ ID NO: 8445 - protein, 15 aa, HIV-1
NNTRKRIRIQRGPGR

SEQ ID NO: 8446 - protein, 9 aa, HIV-1
TRKRIRIQR

SEQ ID NO: 8447 - protein, 15 aa, HIV-1
NPQEVVLVNVTENFN

SEQ ID NO: 8448 - protein, 9 aa, HIV-1
VVLVNVTEN

SEQ ID NO: 8449 - protein, 15 aa, HIV-1
NRVRQGYSPLSFQTH

SEQ ID NO: 8450 - protein, 9 aa, HIV-1
VRQGYSPLS

SEQ ID NO: 8451 - protein, 15 aa, HIV-1
NSAVSLLNATAIAVA

SEQ ID NO: 8452 - protein, 9 aa, HIV-1
LLNATAIAV

SEQ ID NO: 8453 - protein, 15 aa, HIV-1
NSTQLFNSTWFNSTW

SEQ ID NO: 8454 - protein, 9 aa, HIV-1
FNSTWFNST

SEQ ID NO: 8455 - protein, 15 aa, HIV-1
NSTQLFNSTWFNSTW

SEQ ID NO: 8456 - protein, 9 aa, HIV-1
LFNSTWFNS

SEQ ID NO: 8457 - protein, 15 aa, HIV-1
NSTWFNSTWSTEGSN

SEQ ID NO: 8458 - protein, 9 aa, HIV-1
FNSTWSTEG

SEQ ID NO: 8459 - protein, 15 aa, HIV-1
NSTWFNSTWSTEGSN

SEQ ID NO: 8460 - protein, 9 aa, HIV-1
WFNSTWSTE

SEQ ID NO: 8461 - protein, 15 aa, HIV-1
NSTWSTEGSNNTEGS

SEQ ID NO: 8462 - protein, 9 aa, HIV-1
WSTEGSNNT

SEQ ID NO: 8463 - protein, 15 aa, HIV-1
NTLKQIASKLREQFG

SEQ ID NO: 8464 - protein, 9 aa, HIV-1
LKQIASKLR

SEQ ID NO: 8465 - protein, 15 aa, HIV-1
NTRKRIRIQRGPGRA

SEQ ID NO: 8466 - protein, 9 aa, HIV-1
IRIQRGPGR

SEQ ID NO: 8467 - protein, 15 aa, HIV-1
NTSVITQACPKVSFE

SEQ ID NO: 8468 - protein, 9 aa, HIV-1
ITQACPKVS

SEQ ID NO: 8469 - protein, 15 aa, HIV-1
NVTENFNMWKNDMVE

SEQ ID NO: 8470 - protein, 9 aa, HIV-1
FNMWKNDMV

SEQ ID NO: 8471 - protein, 15 aa, HIV-1
NVWATHACVPTDPNP

SEQ ID NO: 8472 - protein, 9 aa, HIV-1
HACVPTDPN

SEQ ID NO: 8473 - protein, 15 aa, HIV-1
NVWATHACVPTDPNP

SEQ ID NO: 8474 - protein, 9 aa, HIV-1
WATHACVPT

SEQ ID NO: 8475 - protein, 15 aa, HIV-1
NWFNITNWLWYIKLF

SEQ ID NO: 8476 - protein, 9 aa, HIV-1
FNITNWLWY

SEQ ID NO: 8477 - protein, 15 aa, HIV-1
NWFNITNWLWYIKLF

SEQ ID NO: 8478 - protein, 9 aa, HIV-1
ITNWLWYIK

SEQ ID NO: 8479 - protein, 15 aa, HIV-1
NWFNITNWLWYIKLF

SEQ ID NO: 8480 - protein, 9 aa, HIV-1
WFNITNWLW

SEQ ID NO: 8481 - protein, 15 aa, HIV-1
NWLWYIKLFIMIVGG

SEQ ID NO: 8482 - protein, 9 aa, HIV-1
IKLFIMIVG

SEQ ID NO: 8483 - protein, 15 aa, HIV-1
NWLWYIKLFIMIVGG

SEQ ID NO: 8484 - protein, 9 aa, HIV-1
LWYIKLFIM

SEQ ID NO: 8485 - protein, 15 aa, HIV-1
NWLWYIKLFIMIVGG

SEQ ID NO: 8486 - protein, 9 aa, HIV-1
YIKLFIMIV

SEQ ID NO: 8487 - protein, 15 aa, HIV-1
NWRSELYKYKVVKIE

SEQ ID NO: 8488 - protein, 9 aa, HIV-1
WRSELYKYK

SEQ ID NO: 8489 - protein, 15 aa, HIV-1
PCRIKQIINMWQKVG

SEQ ID NO: 8490 - protein, 9 aa, HIV-1
IKQIINMWQ

SEQ ID NO: 8491 - protein, 15 aa, HIV-1
PCVKLTPLCVSLKCT

SEQ ID NO: 8492 - protein, 9 aa, HIV-1
LTPLCVSLK

SEQ ID NO: 8493 - protein, 15 aa, HIV-1
PIHYCAPAGFAILKC

SEQ ID NO: 8494 - protein, 9 aa, HIV-1
YCAPAGFAI

SEQ ID NO: 8495 - protein, 15 aa, HIV-1
PIPIHYCAPAGFAIL

SEQ ID NO: 8496 - protein, 9 aa, HIV-1
YCAPAGFAI

SEQ ID NO: 8497 - protein, 15 aa, HIV-1
PLGVAPTKAKRRVVQ

SEQ ID NO: 8498 - protein, 9 aa, HIV-1
PTKAKRRVV

SEQ ID NO: 8499 - protein, 15 aa, HIV-1
PLGVAPTKAKRRVVQ

SEQ ID NO: 8500 - protein, 9 aa, HIV-1
VAPTKAKRR

SEQ ID NO: 8501 - protein, 15 aa, HIV-1
PLSFQTHLPTPRGPD

SEQ ID NO: 8502 - protein, 9 aa, HIV-1
FQTHLPTPR

SEQ ID NO: 8503 - protein, 15 aa, HIV-1
PLSFQTHLPTPRGPD

SEQ ID NO: 8504 - protein, 9 aa, HIV-1
QTHLPTPRG

SEQ ID NO: 8505 - protein, 15 aa, HIV-1
PNPQEVVLVNVTENF

SEQ ID NO: 8506 - protein, 9 aa, HIV-1
VVLVNVTEN

SEQ ID NO: 8507 - protein, 15 aa, HIV-1
PQEVVLVNVTENFNM

SEQ ID NO: 8508 - protein, 9 aa, HIV-1
LVNVTENFN

SEQ ID NO: 8509 - protein, 15 aa, HIV-1
PVVSTQLLLNGSLAE

SEQ ID NO: 8510 - protein, 9 aa, HIV-1
VSTQLLLNG

SEQ ID NO: 8511 - protein, 15 aa, HIV-1
PVWKEATTTLFCASD

SEQ ID NO: 8512 - protein, 9 aa, HIV-1
WKEATTTLF

SEQ ID NO: 8513 - protein, 15 aa, HIV-1
PWNASWSNKSLEQIW

SEQ ID NO: 8514 - protein, 9 aa, HIV-1
WNASWSNKS

SEQ ID NO: 8515 - protein, 15 aa, HIV-1
QARQLLSGIVQQQNN

SEQ ID NO: 8516 - protein, 9 aa, HIV-1
LLSGIVQQQ

SEQ ID NO: 8517 - protein, 15 aa, HIV-1
QCTHGIRPVVSTQLL

SEQ ID NO: 8518 - protein, 9 aa, HIV-1
IRPVVSTQL

SEQ ID NO: 8519 - protein, 15 aa, HIV-1
QELKNSAVSLLNATA

SEQ ID NO: 8520 - protein, 9 aa, HIV-1
LKNSAVSLL

SEQ ID NO: 8521 - protein, 15 aa, HIV-1
QELLELDKWASLWNW

SEQ ID NO: 8522 - protein, 9 aa, HIV-1
LDKWASLWN

SEQ ID NO: 8523 - protein, 15 aa, HIV-1
QEVVLVNVTENFNMW

SEQ ID NO: 8524 - protein, 9 aa, HIV-1
LVNVTENFN

SEQ ID NO: 8525 - protein, 15 aa, HIV-1
QFGNNKTIIFKQSSG

SEQ ID NO: 8526 - protein, 9 aa, HIV-1
FGNNKTIIF

SEQ ID NO: 8527 - protein, 15 aa, HIV-1
QGACRAIRHIPRRIR

SEQ ID NO: 8528 - protein, 9 aa, HIV-1
RAIRHIPRR

SEQ ID NO: 8529 - protein, 15 aa, HIV-1
QHLLQLTVWGIKQLQ

SEQ ID NO: 8530 - protein, 9 aa, HIV-1
LLQLTVWGI

SEQ ID NO: 8531 - protein, 15 aa, HIV-1
QHLWRWGWRWGTMLL

SEQ ID NO: 8532 - protein, 9 aa, HIV-1
LWRWGWRWG

SEQ ID NO: 8533 - protein, 15 aa, HIV-1
QHLWRWGWRWGTMLL

SEQ ID NO: 8534 - protein, 9 aa, HIV-1
QHLWRWGWR

SEQ ID NO: 8535 - protein, 15 aa, HIV-1
QHLWRWGWRWGTMLL

SEQ ID NO: 8536 - protein, 9 aa, HIV-1
WGWRWGTML

SEQ ID NO: 8537 - protein, 15 aa, HIV-1
QIASKLREQFGNNKT

SEQ ID NO: 8538 - protein, 9 aa, HIV-1
LREQFGNNK

SEQ ID NO: 8539 - protein, 15 aa, HIV-1
QIINMWQKVGKAMYA

SEQ ID NO: 8540 - protein, 9 aa, HIV-1
INMWQKVGK

SEQ ID NO: 8541 - protein, 15 aa, HIV-1
QIINMWQKVGKAMYA

SEQ ID NO: 8542 - protein, 9 aa, HIV-1
MWQKVGKAM

SEQ ID NO: 8543 - protein, 15 aa, HIV-1
QIINMWQKVGKAMYA

SEQ ID NO: 8544 - protein, 9 aa, HIV-1
WQKVGKAMY

SEQ ID NO: 8545 - protein, 15 aa, HIV-1
QIWNHTTWMEWDREI

SEQ ID NO: 8546 - protein, 9 aa, HIV-1
IWNHTTWME

SEQ ID NO: 8547 - protein, 15 aa, HIV-1
QKVGKAMYAPPISGQ

SEQ ID NO: 8548 - protein, 9 aa, HIV-1
GKAMYAPPI

SEQ ID NO: 8549 - protein, 15 aa, HIV-1
QLFNSTWFNSTWSTE

SEQ ID NO: 8550 - protein, 9 aa, HIV-1
FNSTWFNST

SEQ ID NO: 8551 - protein, 15 aa, HIV-1
QLFNSTWFNSTWSTE

SEQ ID NO: 8552 - protein, 9 aa, HIV-1
LFNSTWFNS

SEQ ID NO: 8553 - protein, 15 aa, HIV-1
QLFNSTWFNSTWSTE

SEQ ID NO: 8554 - protein, 9 aa, HIV-1
STWFNSTWS

SEQ ID NO: 8555 - protein, 15 aa, HIV-1
QLLSGIVQQQNNLLR

SEQ ID NO: 8556 - protein, 9 aa, HIV-1
IVQQQNNLL

SEQ ID NO: 8557 - protein, 15 aa, HIV-1
QLTVWGIKQLQARIL

SEQ ID NO: 8558 - protein, 9 aa, HIV-1
WGIKQLQAR

SEQ ID NO: 8559 - protein, 15 aa, HIV-1
QNNLLRAIEAQQHLL

SEQ ID NO: 8560 - protein, 9 aa, HIV-1
LRAIEAQQH

SEQ ID NO: 8561 - protein, 15 aa, HIV-1
QQHLLQLTVWGIKQL

SEQ ID NO: 8562 - protein, 9 aa, HIV-1
LLQLTVWGI

SEQ ID NO: 8563 - protein, 15 aa, HIV-1
QQNNLLRAIEAQQHL

SEQ ID NO: 8564 - protein, 9 aa, HIV-1
LRAIEAQQH

SEQ ID NO: 8565 - protein, 15 aa, HIV-1
QQQNNLLRAIEAQQH

SEQ ID NO: 8566 - protein, 9 aa, HIV-1
LLRAIEAQQ

SEQ ID NO: 8567 - protein, 15 aa, HIV-1
QQQNNLLRAIEAQQH

SEQ ID NO: 8568 - protein, 9 aa, HIV-1
NNLLRAIEA

SEQ ID NO: 8569 - protein, 15 aa, HIV-1
QREKRAVGIGALFLG

SEQ ID NO: 8570 - protein, 9 aa, HIV-1
AVGIGALFL

SEQ ID NO: 8571 - protein, 15 aa, HIV-1
QREKRAVGIGALFLG

SEQ ID NO: 8572 - protein, 9 aa, HIV-1
RAVGIGALF

SEQ ID NO: 8573 - protein, 15 aa, HIV-1
QSLKPCVKLTPLCVS

SEQ ID NO: 8574 - protein, 9 aa, HIV-1
CVKLTPLCV

SEQ ID NO: 8575 - protein, 15 aa, HIV-1
QTHLPTPRGPDRPEG

SEQ ID NO: 8576 - protein, 9 aa, HIV-1
QTHLPTPRG

SEQ ID NO: 8577 - protein, 15 aa, HIV-1
QYWSQELKNSAVSLL

SEQ ID NO: 8578 - protein, 9 aa, HIV-1
ELKNSAVSL

SEQ ID NO: 8579 - protein, 15 aa, HIV-1
QYWSQELKNSAVSLL

SEQ ID NO: 8580 - protein, 9 aa, HIV-1
WSQELKNSA

SEQ ID NO: 8581 - protein, 15 aa, HIV-1
RAFVTIGKIGNMRQA

SEQ ID NO: 8582 - protein, 9 aa, HIV-1
FVTIGKIGN

SEQ ID NO: 8583 - protein, 15 aa, HIV-1
RAIRHIPRRIRQGLE

SEQ ID NO: 8584 - protein, 9 aa, HIV-1
IRHIPRRIR

SEQ ID NO: 8585 - protein, 15 aa, HIV-1
RAKWNNTLKQIASKL

SEQ ID NO: 8586 - protein, 9 aa, HIV-1
WNNTLKQIA

SEQ ID NO: 8587 - protein, 15 aa, HIV-1
RAVGIGALFLGFLGA

SEQ ID NO: 8588 - protein, 9 aa, HIV-1
VGIGALFLG

SEQ ID NO: 8589 - protein, 15 aa, HIV-1
RCSSNITGLLLTRDG

SEQ ID NO: 8590 - protein, 9 aa, HIV-1
ITGLLLTRD

SEQ ID NO: 8591 - protein, 15 aa, HIV-1
RDLLLIVTRIVELLG

SEQ ID NO: 8592 - protein, 9 aa, HIV-1
LIVTRIVEL

SEQ ID NO: 8593 - protein, 15 aa, HIV-1
RDLLLIVTRIVELLG

SEQ ID NO: 8594 - protein, 9 aa, HIV-1
LLIVTRIVE

SEQ ID NO: 8595 - protein, 15 aa, HIV-1
RDLLLIVTRIVELLG

SEQ ID NO: 8596 - protein, 9 aa, HIV-1
LLLIVTRIV

SEQ ID NO: 8597 - protein, 15 aa, HIV-1
RDNWRSELYKYKVVK

SEQ ID NO: 8598 - protein, 9 aa, HIV-1
WRSELYKYK

SEQ ID NO: 8599 - protein, 15 aa, HIV-1
RDRDRSIRLVNGSLA

SEQ ID NO: 8600 - protein, 9 aa, HIV-1
DRSIRLVNG

SEQ ID NO: 8601 - protein, 15 aa, HIV-1
RDRSIRLVNGSLALI

SEQ ID NO: 8602 - protein, 9 aa, HIV-1
IRLVNGSLA

SEQ ID NO: 8603 - protein, 15 aa, HIV-1
REINNYTSLIHSLIE

SEQ ID NO: 8604 - protein, 9 aa, HIV-1
INNYTSLIH

SEQ ID NO: 8605 - protein, 15 aa, HIV-1
REINNYTSLIHSLIE

SEQ ID NO: 8606 - protein, 9 aa, HIV-1
YTSLIHSLI

SEQ ID NO: 8607 - protein, 15 aa, HIV-1
REKRAVGIGALFLGF

SEQ ID NO: 8608 - protein, 9 aa, HIV-1
VGIGALFLG

SEQ ID NO: 8609 - protein, 15 aa, HIV-1
REQFGNNKTIIFKQS

SEQ ID NO: 8610 - protein, 9 aa, HIV-1
FGNNKTIIF

SEQ ID NO: 8611 - protein, 15 aa, HIV-1
RGWEALKYWWNLLQY

SEQ ID NO: 8612 - protein, 9 aa, HIV-1
LKYWWNLLQ

SEQ ID NO: 8613 - protein, 15 aa, HIV-1
RIKQIINMWQKVGKA

SEQ ID NO: 8614 - protein, 9 aa, HIV-1
IINMWQKVG

SEQ ID NO: 8615 - protein, 15 aa, HIV-1
RIKQIINMWQKVGKA

SEQ ID NO: 8616 - protein, 9 aa, HIV-1
INMWQKVGK

SEQ ID NO: 8617 - protein, 15 aa, HIV-1
RIQRGPGRAFVTIGK

SEQ ID NO: 8618 - protein, 9 aa, HIV-1
IQRGPGRAF

SEQ ID NO: 8619 - protein, 15 aa, HIV-1
RIRIQRGPGRAFVTI

SEQ ID NO: 8620 - protein, 9 aa, HIV-1
IQRGPGRAF

SEQ ID NO: 8621 - protein, 15 aa, HIV-1
RIRIQRGPGRAFVTI

SEQ ID NO: 8622 - protein, 9 aa, HIV-1
IRIQRGPGR

SEQ ID NO: 8623 - protein, 15 aa, HIV-1
RIVELLGRRGWEALK

SEQ ID NO: 8624 - protein, 9 aa, HIV-1
IVELLGRRG

SEQ ID NO: 8625 - protein, 15 aa, HIV-1
RIVFAVLSIVNRVRQ

SEQ ID NO: 8626 - protein, 9 aa, HIV-1
FAVLSIVNR

SEQ ID NO: 8627 - protein, 15 aa, HIV-1
RIVFAVLSIVNRVRQ

SEQ ID NO: 8628 - protein, 9 aa, HIV-1
VLSIVNRVR

SEQ ID NO: 8629 - protein, 15 aa, HIV-1
RKRIRIQRGPGRAFV

SEQ ID NO: 8630 - protein, 9 aa, HIV-1
IQRGPGRAF

SEQ ID NO: 8631 - protein, 15 aa, HIV-1
RKRIRIQRGPGRAFV

SEQ ID NO: 8632 - protein, 9 aa, HIV-1
IRIQRGPGR

SEQ ID NO: 8633 - protein, 15 aa, HIV-1
RLRDLLLIVTRIVEL

SEQ ID NO: 8634 - protein, 9 aa, HIV-1
LLIVTRIVE

SEQ ID NO: 8635 - protein, 15 aa, HIV-1
RLRDLLLIVTRIVEL

SEQ ID NO: 8636 - protein, 9 aa, HIV-1
LLLIVTRIV

SEQ ID NO: 8637 - protein, 15 aa, HIV-1
RLRDLLLIVTRIVEL

SEQ ID NO: 8638 - protein, 9 aa, HIV-1
LRDLLLIVT

SEQ ID NO: 8639 - protein, 15 aa, HIV-1
RLVNGSLALIWDDLR

SEQ ID NO: 8640 - protein, 9 aa, HIV-1
VNGSLALIW

SEQ ID NO: 8641 - protein, 15 aa, HIV-1
RPVVSTQLLLNGSLA

SEQ ID NO: 8642 - protein, 9 aa, HIV-1
VVSTQLLLN

SEQ ID NO: 8643 - protein, 15 aa, HIV-1
RQGYSPLSFQTHLPT

SEQ ID NO: 8644 - protein, 9 aa, HIV-1
YSPLSFQTH

SEQ ID NO: 8645 - protein, 15 aa, HIV-1
RQLLSGIVQQQNNLL

SEQ ID NO: 8646 - protein, 9 aa, HIV-1
LLSGIVQQQ

SEQ ID NO: 8647 - protein, 15 aa, HIV-1
RQLLSGIVQQQNNLL

SEQ ID NO: 8648 - protein, 9 aa, HIV-1
LSGIVQQQN

SEQ ID NO: 8649 - protein, 15 aa, HIV-1
RRGWEALKYWWNLLQ

SEQ ID NO: 8650 - protein, 9 aa, HIV-1
RRGWEALKY

SEQ ID NO: 8651 - protein, 15 aa, HIV-1
RRGWEALKYWWNLLQ

SEQ ID NO: 8652 - protein, 9 aa, HIV-1
WEALKYWWN

SEQ ID NO: 8653 - protein, 15 aa, HIV-1
RSELYKYKVVKIEPL

SEQ ID NO: 8654 - protein, 9 aa, HIV-1
LYKYKVVKI

SEQ ID NO: 8655 - protein, 15 aa, HIV-1
RSELYKYKVVKIEPL

SEQ ID NO: 8656 - protein, 9 aa, HIV-1
YKYKVVKIE

SEQ ID NO: 8657 - protein, 15 aa, HIV-1
RSIRLVNGSLALIWD

SEQ ID NO: 8658 - protein, 9 aa, HIV-1
IRLVNGSLA

SEQ ID NO: 8659 - protein, 15 aa, HIV-1
RSIRLVNGSLALIWD

SEQ ID NO: 8660 - protein, 9 aa, HIV-1
LVNGSLALI

SEQ ID NO: 8661 - protein, 15 aa, HIV-1
RVIEVVQGACRAIRH

SEQ ID NO: 8662 - protein, 9 aa, HIV-1
VVQGACRAI

SEQ ID NO: 8663 - protein, 15 aa, HIV-1
RVKEKYQHLWRWGWR

SEQ ID NO: 8664 - protein, 9 aa, HIV-1
YQHLWRWGW

SEQ ID NO: 8665 - protein, 15 aa, HIV-1
RVRQGYSPLSFQTHL

SEQ ID NO: 8666 - protein, 9 aa, HIV-1
VRQGYSPLS

SEQ ID NO: 8667 - protein, 15 aa, HIV-1
RWGTMLLGMLMICSA

SEQ ID NO: 8668 - protein, 9 aa, HIV-1
LLGMLMICS

SEQ ID NO: 8669 - protein, 15 aa, HIV-1
RWGTMLLGMLMICSA

SEQ ID NO: 8670 - protein, 9 aa, HIV-1
WGTMLLGML

SEQ ID NO: 8671 - protein, 15 aa, HIV-1
RWGWRWGTMLLGMLM

SEQ ID NO: 8672 - protein, 9 aa, HIV-1
WGTMLLGML

SEQ ID NO: 8673 - protein, 15 aa, HIV-1
RWGWRWGTMLLGMLM

SEQ ID NO: 8674 - protein, 9 aa, HIV-1
WRWGTMLLG

SEQ ID NO: 8675 - protein, 15 aa, HIV-1
SAVSLLNATAIAVAE

SEQ ID NO: 8676 - protein, 9 aa, HIV-1
LLNATAIAV

SEQ ID NO: 8677 - protein, 15 aa, HIV-1
SCNTSVITQACPKVS

SEQ ID NO: 8678 - protein, 9 aa, HIV-1
VITQACPKV

SEQ ID NO: 8679 - protein, 15 aa, HIV-1
SELYKYKVVKIEPLG

SEQ ID NO: 8680 - protein, 9 aa, HIV-1
YKVVKIEPL

SEQ ID NO: 8681 - protein, 15 aa, HIV-1
SFNISTSIRGKVQKE

SEQ ID NO: 8682 - protein, 9 aa, HIV-1
FNISTSIRG

SEQ ID NO: 8683 - protein, 15 aa, HIV-1
SFQTHLPTPRGPDRP

SEQ ID NO: 8684 - protein, 9 aa, HIV-1
FQTHLPTPR

SEQ ID NO: 8685 - protein, 15 aa, HIV-1
SFQTHLPTPRGPDRP

SEQ ID NO: 8686 - protein, 9 aa, HIV-1
QTHLPTPRG

SEQ ID NO: 8687 - protein, 15 aa, HIV-1
SGIVQQQNNLLRAIE

SEQ ID NO: 8688 - protein, 9 aa, HIV-1
IVQQQNNLL

SEQ ID NO: 8689 - protein, 15 aa, HIV-1
SGIVQQQNNLLRAIE

SEQ ID NO: 8690 - protein, 9 aa, HIV-1
VQQQNNLLR

SEQ ID NO: 8691 - protein, 15 aa, HIV-1
SGKLICTTAVPWNAS

SEQ ID NO: 8692 - protein, 9 aa, HIV-1
ICTTAVPWN

SEQ ID NO: 8693 - protein, 15 aa, HIV-1
SGKLICTTAVPWNAS

SEQ ID NO: 8694 - protein, 9 aa, HIV-1
LICTTAVPW

SEQ ID NO: 8695 - protein, 15 aa, HIV-1
SIRLVNGSLALIWDD

SEQ ID NO: 8696 - protein, 9 aa, HIV-1
IRLVNGSLA

SEQ ID NO: 8697 - protein, 15 aa, HIV-1
SIRLVNGSLALIWDD

SEQ ID NO: 8698 - protein, 9 aa, HIV-1
LVNGSLALI

SEQ ID NO: 8699 - protein, 15 aa, HIV-1
SIVNRVRQGYSPLSF

SEQ ID NO: 8700 - protein, 9 aa, HIV-1
IVNRVRQGY

SEQ ID NO: 8701 - protein, 15 aa, HIV-1
SIVNRVRQGYSPLSF

SEQ ID NO: 8702 - protein, 9 aa, HIV-1
VRQGYSPLS

SEQ ID NO: 8703 - protein, 15 aa, HIV-1
SKLREQFGNNKTIIF

SEQ ID NO: 8704 - protein, 9 aa, HIV-1
LREQFGNNK

SEQ ID NO: 8705 - protein, 15 aa, HIV-1
SKLREQFGNNKTIIF

SEQ ID NO: 8706 - protein, 9 aa, HIV-1
QFGNNKTII

SEQ ID NO: 8707 - protein, 15 aa, HIV-1
SLAEEEVVIRSVNFT

SEQ ID NO: 8708 - protein, 9 aa, HIV-1
EEVVIRSVN

SEQ ID NO: 8709 - protein, 15 aa, HIV-1
SLAEEEVVIRSVNFT

SEQ ID NO: 8710 - protein, 9 aa, HIV-1
EVVIRSVNF

SEQ ID NO: 8711 - protein, 15 aa, HIV-1
SLALIWDDLRSLCLF

SEQ ID NO: 8712 - protein, 9 aa, HIV-1
WDDLRSLCL

SEQ ID NO: 8713 - protein, 15 aa, HIV-1
SLCLFSYHRLRDLLL

SEQ ID NO: 8714 - protein, 9 aa, HIV-1
FSYHRLRDL

SEQ ID NO: 8715 - protein, 15 aa, HIV-1
SLEQIWNHTTWMEWD

SEQ ID NO: 8716 - protein, 9 aa, HIV-1
IWNHTTWME

SEQ ID NO: 8717 - protein, 15 aa, HIV-1
SLEQIWNHTTWMEWD

SEQ ID NO: 8718 - protein, 9 aa, HIV-1
WNHTTWMEW

SEQ ID NO: 8719 - protein, 15 aa, HIV-1
SLKCTDLKNDTNTNS

SEQ ID NO: 8720 - protein, 9 aa, HIV-1
DLKNDTNTN

SEQ ID NO: 8721 - protein, 15 aa, HIV-1
SLKPCVKLTPLCVSL

SEQ ID NO: 8722 - protein, 9 aa, HIV-1
VKLTPLCVS

SEQ ID NO: 8723 - protein, 15 aa, HIV-1
SLLNATAIAVAEGTD

SEQ ID NO: 8724 - protein, 9 aa, HIV-1
LLNATAIAV

SEQ ID NO: 8725 - protein, 15 aa, HIV-1
SLWDQSLKPCVKLTP

SEQ ID NO: 8726 - protein, 9 aa, HIV-1
LWDQSLKPC

SEQ ID NO: 8727 - protein, 15 aa, HIV-1
SLWNWFNITNWLWYI

SEQ ID NO: 8728 - protein, 9 aa, HIV-1
FNITNWLWY

SEQ ID NO: 8729 - protein, 15 aa, HIV-1
SLWNWFNITNWLWYI

SEQ ID NO: 8730 - protein, 9 aa, HIV-1
WFNITNWLW

SEQ ID NO: 8731 - protein, 15 aa, HIV-1
SLWNWFNITNWLWYI

SEQ ID NO: 8732 - protein, 9 aa, HIV-1
WNWFNITNW

SEQ ID NO: 8733 - protein, 15 aa, HIV-1
SMTLTVQARQLLSGI

SEQ ID NO: 8734 - protein, 9 aa, HIV-1
LTVQARQLL

SEQ ID NO: 8735 - protein, 15 aa, HIV-1
SMTLTVQARQLLSGI

SEQ ID NO: 8736 - protein, 9 aa, HIV-1
VQARQLLSG

SEQ ID NO: 8737 - protein, 15 aa, HIV-1
SNITGLLLTRDGGNS

SEQ ID NO: 8738 - protein, 9 aa, HIV-1
ITGLLLTRD

SEQ ID NO: 8739 - protein, 15 aa, HIV-1
SPLSFQTHLPTPRGP

SEQ ID NO: 8740 - protein, 9 aa, HIV-1
FQTHLPTPR

SEQ ID NO: 8741 - protein, 15 aa, HIV-1
SPLSFQTHLPTPRGP

SEQ ID NO: 8742 - protein, 9 aa, HIV-1
QTHLPTPRG

SEQ ID NO: 8743 - protein, 15 aa, HIV-1
SQELKNSAVSLLNAT

SEQ ID NO: 8744 - protein, 9 aa, HIV-1
LKNSAVSLL

SEQ ID NO: 8745 - protein, 15 aa, HIV-1
SRAKWNNTLKQIASK

SEQ ID NO: 8746 - protein, 9 aa, HIV-1
WNNTLKQIA

SEQ ID NO: 8747 - protein, 15 aa, HIV-1
SSNITGLLLTRDGGN

SEQ ID NO: 8748 - protein, 9 aa, HIV-1
ITGLLLTRD

SEQ ID NO: 8749 - protein, 15 aa, HIV-1
STMGAASMTLTVQAR

SEQ ID NO: 8750 - protein, 9 aa, HIV-1
MGAASMTLT

SEQ ID NO: 8751 - protein, 15 aa, HIV-1
STQLFNSTWFNSTWS

SEQ ID NO: 8752 - protein, 9 aa, HIV-1
FNSTWFNST

SEQ ID NO: 8753 - protein, 15 aa, HIV-1
STQLFNSTWFNSTWS

SEQ ID NO: 8754 - protein, 9 aa, HIV-1
LFNSTWFNS

SEQ ID NO: 8755 - protein, 15 aa, HIV-1
STQLLLNGSLAEEEV

SEQ ID NO: 8756 - protein, 9 aa, HIV-1
LLLNGSLAE

SEQ ID NO: 8757 - protein, 15 aa, HIV-1
STVQCTHGIRPVVST

SEQ ID NO: 8758 - protein, 9 aa, HIV-1
THGIRPVVS

SEQ ID NO: 8759 - protein, 15 aa, HIV-1
STWFNSTWSTEGSNN

SEQ ID NO: 8760 - protein, 9 aa, HIV-1
FNSTWSTEG

SEQ ID NO: 8761 - protein, 15 aa, HIV-1
STWFNSTWSTEGSNN

SEQ ID NO: 8762 - protein, 9 aa, HIV-1
WFNSTWSTE

SEQ ID NO: 8763 - protein, 15 aa, HIV-1
STWSTEGSNNTEGSD

SEQ ID NO: 8764 - protein, 9 aa, HIV-1
WSTEGSNNT

SEQ ID NO: 8765 - protein, 15 aa, HIV-1
SVEINCTRPNNNTRK

SEQ ID NO: 8766 - protein, 9 aa, HIV-1
INCTRPNNN

SEQ ID NO: 8767 - protein, 15 aa, HIV-1
SVITQACPKVSFEPI

SEQ ID NO: 8768 - protein, 9 aa, HIV-1
ITQACPKVS

SEQ ID NO: 8769 - protein, 15 aa, HIV-1
SYHRLRDLLLIVTRI

SEQ ID NO: 8770 - protein, 9 aa, HIV-1
LRDLLLIVT

SEQ ID NO: 8771 - protein, 15 aa, HIV-1
SYKLTSCNTSVITQA

SEQ ID NO: 8772 - protein, 9 aa, HIV-1
LTSCNTSVI

SEQ ID NO: 8773 - protein, 15 aa, HIV-1
TAIAVAEGTDRVIEV

SEQ ID NO: 8774 - protein, 9 aa, HIV-1
IAVAEGTDR

SEQ ID NO: 8775 - protein, 15 aa, HIV-1
TAVPWNASWSNKSLE

SEQ ID NO: 8776 - protein, 9 aa, HIV-1
VPWNASWSN

SEQ ID NO: 8777 - protein, 15 aa, HIV-1
TAVPWNASWSNKSLE

SEQ ID NO: 8778 - protein, 9 aa, HIV-1
WNASWSNKS

SEQ ID NO: 8779 - protein, 15 aa, HIV-1
TDLKNDTNTNSSSGR

SEQ ID NO: 8780 - protein, 9 aa, HIV-1
LKNDTNTNS

SEQ ID NO: 8781 - protein, 15 aa, HIV-1
TDNAKTIIVQLNTSV

SEQ ID NO: 8782 - protein, 9 aa, HIV-1
AKTIIVQLN

SEQ ID NO: 8783 - protein, 15 aa, HIV-1
TDRVIEVVQGACRAI

SEQ ID NO: 8784 - protein, 9 aa, HIV-1
EVVQGACRA

SEQ ID NO: 8785 - protein, 15 aa, HIV-1
TENFNMWKNDMVEQM

SEQ ID NO: 8786 - protein, 9 aa, HIV-1
FNMWKNDMV

SEQ ID NO: 8787 - protein, 15 aa, HIV-1
TENFNMWKNDMVEQM

SEQ ID NO: 8788 - protein, 9 aa, HIV-1
MWKNDMVEQ

SEQ ID NO: 8789 - protein, 15 aa, HIV-1
TEVHNVWATHACVPT

SEQ ID NO: 8790 - protein, 9 aa, HIV-1
VHNVWATHA

SEQ ID NO: 8791 - protein, 15 aa, HIV-1
TFNGTGPCTNVSTVQ

SEQ ID NO: 8792 - protein, 9 aa, HIV-1
FNGTGPCTN

SEQ ID NO: 8793 - protein, 15 aa, HIV-1
THACVPTDPNPQEVV

SEQ ID NO: 8794 - protein, 9 aa, HIV-1
VPTDPNPQE

SEQ ID NO: 8795 - protein, 15 aa, HIV-1
THGIRPVVSTQLLLN

SEQ ID NO: 8796 - protein, 9 aa, HIV-1
IRPVVSTQL

SEQ ID NO: 8797 - protein, 15 aa, HIV-1
TIIFKQSSGGDPEIV

SEQ ID NO: 8798 - protein, 9 aa, HIV-1
FKQSSGGDP

SEQ ID NO: 8799 - protein, 15 aa, HIV-1
TIIVQLNTSVEINCT

SEQ ID NO: 8800 - protein, 9 aa, HIV-1
IVQLNTSVE

SEQ ID NO: 8801 - protein, 15 aa, HIV-1
TIIVQLNTSVEINCT

SEQ ID NO: 8802 - protein, 9 aa, HIV-1
VQLNTSVEI

SEQ ID NO: 8803 - protein, 15 aa, HIV-1
TLFCASDAKAYDTEV

SEQ ID NO: 8804 - protein, 9 aa, HIV-1
FCASDAKAY

SEQ ID NO: 8805 - protein, 15 aa, HIV-1
TLKQIASKLREQFGN

SEQ ID NO: 8806 - protein, 9 aa, HIV-1
LKQIASKLR

SEQ ID NO: 8807 - protein, 15 aa, HIV-1
TLTVQARQLLSGIVQ

SEQ ID NO: 8808 - protein, 9 aa, HIV-1
LTVQARQLL

SEQ ID NO: 8809 - protein, 15 aa, HIV-1
TLTVQARQLLSGIVQ

SEQ ID NO: 8810 - protein, 9 aa, HIV-1
VQARQLLSG

SEQ ID NO: 8811 - protein, 15 aa, HIV-1
TMGAASMTLTVQARQ

SEQ ID NO: 8812 - protein, 9 aa, HIV-1
MGAASMTLT

SEQ ID NO: 8813 - protein, 15 aa, HIV-1
TMLLGMLMICSATEK

SEQ ID NO: 8814 - protein, 9 aa, HIV-1
LLGMLMICS

SEQ ID NO: 8815 - protein, 15 aa, HIV-1
TNWLWYIKLFIMIVG

SEQ ID NO: 8816 - protein, 9 aa, HIV-1
LWYIKLFIM

SEQ ID NO: 8817 - protein, 15 aa, HIV-1
TNWLWYIKLFIMIVG

SEQ ID NO: 8818 - protein, 9 aa, HIV-1
WLWYIKLFI

SEQ ID NO: 8819 - protein, 15 aa, HIV-1
TNWLWYIKLFIMIVG

SEQ ID NO: 8820 - protein, 9 aa, HIV-1
YIKLFIMIV

SEQ ID NO: 8821 - protein, 15 aa, HIV-1
TQLFNSTWFNSTWST

SEQ ID NO: 8822 - protein, 9 aa, HIV-1
FNSTWFNST

SEQ ID NO: 8823 - protein, 15 aa, HIV-1
TQLFNSTWFNSTWST

SEQ ID NO: 8824 - protein, 9 aa, HIV-1
LFNSTWFNS

SEQ ID NO: 8825 - protein, 15 aa, HIV-1
TQLFNSTWFNSTWST

SEQ ID NO: 8826 - protein, 9 aa, HIV-1
STWFNSTWS

SEQ ID NO: 8827 - protein, 15 aa, HIV-1
TRIVELLGRRGWEAL

SEQ ID NO: 8828 - protein, 9 aa, HIV-1
IVELLGRRG

SEQ ID NO: 8829 - protein, 15 aa, HIV-1
TRIVELLGRRGWEAL

SEQ ID NO: 8830 - protein, 9 aa, HIV-1
TRIVELLGR

SEQ ID NO: 8831 - protein, 15 aa, HIV-1
TRKRIRIQRGPGRAF

SEQ ID NO: 8832 - protein, 9 aa, HIV-1
IRIQRGPGR

SEQ ID NO: 8833 - protein, 15 aa, HIV-1
TRKRIRIQRGPGRAF

SEQ ID NO: 8834 - protein, 9 aa, HIV-1
RKRIRIQRG

SEQ ID NO: 8835 - protein, 15 aa, HIV-1
TRPNNNTRKRIRIQR

SEQ ID NO: 8836 - protein, 9 aa, HIV-1
PNNNTRKRI

SEQ ID NO: 8837 - protein, 15 aa, HIV-1
TSVITQACPKVSFEP

SEQ ID NO: 8838 - protein, 9 aa, HIV-1
ITQACPKVS

SEQ ID NO: 8839 - protein, 15 aa, HIV-1
TSYKLTSCNTSVITQ

SEQ ID NO: 8840 - protein, 9 aa, HIV-1
LTSCNTSVI

SEQ ID NO: 8841 - protein, 15 aa, HIV-1
TTAVPWNASWSNKSL

SEQ ID NO: 8842 - protein, 9 aa, HIV-1
VPWNASWSN

SEQ ID NO: 8843 - protein, 15 aa, HIV-1
TTAVPWNASWSNKSL

SEQ ID NO: 8844 - protein, 9 aa, HIV-1
WNASWSNKS

SEQ ID NO: 8845 - protein, 15 aa, HIV-1
TTLFCASDAKAYDTE

SEQ ID NO: 8846 - protein, 9 aa, HIV-1
FCASDAKAY

SEQ ID NO: 8847 - protein, 15 aa, HIV-1
TTSYKLTSCNTSVIT

SEQ ID NO: 8848 - protein, 9 aa, HIV-1
LTSCNTSVI

SEQ ID NO: 8849 - protein, 15 aa, HIV-1
TTSYKLTSCNTSVIT

SEQ ID NO: 8850 - protein, 9 aa, HIV-1
YKLTSCNTS

SEQ ID NO: 8851 - protein, 15 aa, HIV-1
TTTLFCASDAKAYDT

SEQ ID NO: 8852 - protein, 9 aa, HIV-1
FCASDAKAY

SEQ ID NO: 8853 - protein, 15 aa, HIV-1
TTWMEWDREINNYTS

SEQ ID NO: 8854 - protein, 9 aa, HIV-1
MEWDREINN

SEQ ID NO: 8855 - protein, 15 aa, HIV-1
TVQARQLLSGIVQQQ

SEQ ID NO: 8856 - protein, 9 aa, HIV-1
VQARQLLSG

SEQ ID NO: 8857 - protein, 15 aa, HIV-1
TVQCTHGIRPVVSTQ

SEQ ID NO: 8858 - protein, 9 aa, HIV-1
THGIRPVVS

SEQ ID NO: 8859 - protein, 15 aa, HIV-1
TVWGIKQLQARILAV

SEQ ID NO: 8860 - protein, 9 aa, HIV-1
IKQLQARIL

SEQ ID NO: 8861 - protein, 15 aa, HIV-1
TVWGIKQLQARILAV

SEQ ID NO: 8862 - protein, 9 aa, HIV-1
WGIKQLQAR

SEQ ID NO: 8863 - protein, 15 aa, HIV-1
TVYYGVPVWKEATTT

SEQ ID NO: 8864 - protein, 9 aa, HIV-1
YYGVPVWKE

SEQ ID NO: 8865 - protein, 15 aa, HIV-1
TWFNSTWSTEGSNNT

SEQ ID NO: 8866 - protein, 9 aa, HIV-1
FNSTWSTEG

SEQ ID NO: 8867 - protein, 15 aa, HIV-1
TWMEWDREINNYTSL

SEQ ID NO: 8868 - protein, 9 aa, HIV-1
MEWDREINN

SEQ ID NO: 8869 - protein, 15 aa, HIV-1
VAPTKAKRRVVQREK

SEQ ID NO: 8870 - protein, 9 aa, HIV-1
PTKAKRRVV

SEQ ID NO: 8871 - protein, 15 aa, HIV-1
VAPTKAKRRVVQREK

SEQ ID NO: 8872 - protein, 9 aa, HIV-1
VAPTKAKRR

SEQ ID NO: 8873 - protein, 15 aa, HIV-1
VEINCTRPNNNTRKR

SEQ ID NO: 8874 - protein, 9 aa, HIV-1
TRPNNNTRK

SEQ ID NO: 8875 - protein, 15 aa, HIV-1
VFAVLSIVNRVRQGY

SEQ ID NO: 8876 - protein, 9 aa, HIV-1
LSIVNRVRQ

SEQ ID NO: 8877 - protein, 15 aa, HIV-1
VFAVLSIVNRVRQGY

SEQ ID NO: 8878 - protein, 9 aa, HIV-1
VFAVLSIVN

SEQ ID NO: 8879 - protein, 15 aa, HIV-1
VFAVLSIVNRVRQGY

SEQ ID NO: 8880 - protein, 9 aa, HIV-1
VLSIVNRVR

SEQ ID NO: 8881 - protein, 15 aa, HIV-1
VGGLVGLRIVFAVLS

SEQ ID NO: 8882 - protein, 9 aa, HIV-1
LVGLRIVFA

SEQ ID NO: 8883 - protein, 15 aa, HIV-1
VGGLVGLRIVFAVLS

SEQ ID NO: 8884 - protein, 9 aa, HIV-1
VGLRIVFAV

SEQ ID NO: 8885 - protein, 15 aa, HIV-1
VGIGALFLGFLGAAG

SEQ ID NO: 8886 - protein, 9 aa, HIV-1
IGALFLGFL

SEQ ID NO: 8887 - protein, 15 aa, HIV-1
VGIGALFLGFLGAAG

SEQ ID NO: 8888 - protein, 9 aa, HIV-1
LFLGFLGAA

SEQ ID NO: 8889 - protein, 15 aa, HIV-1
VGKAMYAPPISGQIR

SEQ ID NO: 8890 - protein, 9 aa, HIV-1
YAPPISGQI

SEQ ID NO: 8891 - protein, 15 aa, HIV-1
VGLRIVFAVLSIVNR

SEQ ID NO: 8892 - protein, 9 aa, HIV-1
IVFAVLSIV

SEQ ID NO: 8893 - protein, 15 aa, HIV-1
VGLRIVFAVLSIVNR

SEQ ID NO: 8894 - protein, 9 aa, HIV-1
LRIVFAVLS

SEQ ID NO: 8895 - protein, 15 aa, HIV-1
VHNVWATHACVPTDP

SEQ ID NO: 8896 - protein, 9 aa, HIV-1
WATHACVPT

SEQ ID NO: 8897 - protein, 15 aa, HIV-1
VIEVVQGACRAIRHI

SEQ ID NO: 8898 - protein, 9 aa, HIV-1
VVQGACRAI

SEQ ID NO: 8899 - protein, 15 aa, HIV-1
VITQACPKVSFEPIP

SEQ ID NO: 8900 - protein, 9 aa, HIV-1
ITQACPKVS

SEQ ID NO: 8901 - protein, 15 aa, HIV-1
VKEKYQHLWRWGWRW

SEQ ID NO: 8902 - protein, 9 aa, HIV-1
QHLWRWGWR

SEQ ID NO: 8903 - protein, 15 aa, HIV-1
VKIEPLGVAPTKAKR

SEQ ID NO: 8904 - protein, 9 aa, HIV-1
IEPLGVAPT

SEQ ID NO: 8905 - protein, 15 aa, HIV-1
VKIEPLGVAPTKAKR

SEQ ID NO: 8906 - protein, 9 aa, HIV-1
LGVAPTKAK

SEQ ID NO: 8907 - protein, 15 aa, HIV-1
VKLTPLCVSLKCTDL

SEQ ID NO: 8908 - protein, 9 aa, HIV-1
LTPLCVSLK

SEQ ID NO: 8909 - protein, 15 aa, HIV-1
VLSIVNRVRQGYSPL

SEQ ID NO: 8910 - protein, 9 aa, HIV-1
IVNRVRQGY

SEQ ID NO: 8911 - protein, 15 aa, HIV-1
VNGSLALIWDDLRSL

SEQ ID NO: 8912 - protein, 9 aa, HIV-1
VNGSLALIW

SEQ ID NO: 8913 - protein, 15 aa, HIV-1
VNRVRQGYSPLSFQT

SEQ ID NO: 8914 - protein, 9 aa, HIV-1
VRQGYSPLS

SEQ ID NO: 8915 - protein, 15 aa, HIV-1
VNVTENFNMWKNDMV

SEQ ID NO: 8916 - protein, 9 aa, HIV-1
NFNMWKNDM

SEQ ID NO: 8917 - protein, 15 aa, HIV-1
VNVTENFNMWKNDMV

SEQ ID NO: 8918 - protein, 9 aa, HIV-1
TENFNMWKN

SEQ ID NO: 8919 - protein, 15 aa, HIV-1
VPVWKEATTTLFCAS

SEQ ID NO: 8920 - protein, 9 aa, HIV-1
WKEATTTLF

SEQ ID NO: 8921 - protein, 15 aa, HIV-1
VPWNASWSNKSLEQI

SEQ ID NO: 8922 - protein, 9 aa, HIV-1
WNASWSNKS

SEQ ID NO: 8923 - protein, 15 aa, HIV-1
VQARQLLSGIVQQQN

SEQ ID NO: 8924 - protein, 9 aa, HIV-1
VQARQLLSG

SEQ ID NO: 8925 - protein, 15 aa, HIV-1
VQCTHGIRPVVSTQL

SEQ ID NO: 8926 - protein, 9 aa, HIV-1
THGIRPVVS

SEQ ID NO: 8927 - protein, 15 aa, HIV-1
VQLNTSVEINCTRPN

SEQ ID NO: 8928 - protein, 9 aa, HIV-1
VQLNTSVEI

SEQ ID NO: 8929 - protein, 15 aa, HIV-1
VQQQNNLLRAIEAQQ

SEQ ID NO: 8930 - protein, 9 aa, HIV-1
VQQQNNLLR

SEQ ID NO: 8931 - protein, 15 aa, HIV-1
VQREKRAVGIGALFL

SEQ ID NO: 8932 - protein, 9 aa, HIV-1
VQREKRAVG

SEQ ID NO: 8933 - protein, 15 aa, HIV-1
VRQGYSPLSFQTHLP

SEQ ID NO: 8934 - protein, 9 aa, HIV-1
VRQGYSPLS

SEQ ID NO: 8935 - protein, 15 aa, HIV-1
VSLLNATAIAVAEGT

SEQ ID NO: 8936 - protein, 9 aa, HIV-1
LLNATAIAV

SEQ ID NO: 8937 - protein, 15 aa, HIV-1
VSTQLLLNGSLAEEE

SEQ ID NO: 8938 - protein, 9 aa, HIV-1
LLLNGSLAE

SEQ ID NO: 8939 - protein, 15 aa, HIV-1
VSTVQCTHGIRPVVS

SEQ ID NO: 8940 - protein, 9 aa, HIV-1
VQCTHGIRP

SEQ ID NO: 8941 - protein, 15 aa, HIV-1
VTENFNMWKNDMVEQ

SEQ ID NO: 8942 - protein, 9 aa, HIV-1
FNMWKNDMV

SEQ ID NO: 8943 - protein, 15 aa, HIV-1
VTIGKIGNMRQAHCN

SEQ ID NO: 8944 - protein, 9 aa, HIV-1
IGNMRQAHC

SEQ ID NO: 8945 - protein, 15 aa, HIV-1
VTRIVELLGRRGWEA

SEQ ID NO: 8946 - protein, 9 aa, HIV-1
IVELLGRRG

SEQ ID NO: 8947 - protein, 15 aa, HIV-1
VTRIVELLGRRGWEA

SEQ ID NO: 8948 - protein, 9 aa, HIV-1
TRIVELLGR

SEQ ID NO: 8949 - protein, 15 aa, HIV-1
VTVYYGVPVWKEATT

SEQ ID NO: 8950 - protein, 9 aa, HIV-1
YYGVPVWKE

SEQ ID NO: 8951 - protein, 15 aa, HIV-1
VVIRSVNFTDNAKTI

SEQ ID NO: 8952 - protein, 9 aa, HIV-1
VVIRSVNFT

SEQ ID NO: 8953 - protein, 15 aa, HIV-1
VVKIEPLGVAPTKAK

SEQ ID NO: 8954 - protein, 9 aa, HIV-1
IEPLGVAPT

SEQ ID NO: 8955 - protein, 15 aa, HIV-1
VVKIEPLGVAPTKAK

SEQ ID NO: 8956 - protein, 9 aa, HIV-1
VKIEPLGVA

SEQ ID NO: 8957 - protein, 15 aa, HIV-1
VVLVNVTENFNMWKN

SEQ ID NO: 8958 - protein, 9 aa, HIV-1
LVNVTENFN

SEQ ID NO: 8959 - protein, 15 aa, HIV-1
VVSTQLLLNGSLAEE

SEQ ID NO: 8960 - protein, 9 aa, HIV-1
STQLLLNGS

SEQ ID NO: 8961 - protein, 15 aa, HIV-1
VWATHACVPTDPNPQ

SEQ ID NO: 8962 - protein, 9 aa, HIV-1
HACVPTDPN

SEQ ID NO: 8963 - protein, 15 aa, HIV-1
VWGIKQLQARILAVE

SEQ ID NO: 8964 - protein, 9 aa, HIV-1
IKQLQARIL

SEQ ID NO: 8965 - protein, 15 aa, HIV-1
VWGIKQLQARILAVE

SEQ ID NO: 8966 - protein, 9 aa, HIV-1
WGIKQLQAR

SEQ ID NO: 8967 - protein, 15 aa, HIV-1
VWKEATTTLFCASDA

SEQ ID NO: 8968 - protein, 9 aa, HIV-1
WKEATTTLF

SEQ ID NO: 8969 - protein, 15 aa, HIV-1
VYYGVPVWKEATTTL

SEQ ID NO: 8970 - protein, 9 aa, HIV-1
PVWKEATTT

SEQ ID NO: 8971 - protein, 15 aa, HIV-1
VYYGVPVWKEATTTL

SEQ ID NO: 8972 - protein, 9 aa, HIV-1
YYGVPVWKE

SEQ ID NO: 8973 - protein, 15 aa, HIV-1
WASLWNWFNITNWLW

SEQ ID NO: 8974 - protein, 9 aa, HIV-1
ASLWNWFNI

SEQ ID NO: 8975 - protein, 15 aa, HIV-1
WASLWNWFNITNWLW

SEQ ID NO: 8976 - protein, 9 aa, HIV-1
WASLWNWFN

SEQ ID NO: 8977 - protein, 15 aa, HIV-1
WATHACVPTDPNPQE

SEQ ID NO: 8978 - protein, 9 aa, HIV-1
HACVPTDPN

SEQ ID NO: 8979 - protein, 15 aa, HIV-1
WDDLRSLCLFSYHRL

SEQ ID NO: 8980 - protein, 9 aa, HIV-1
LRSLCLFSY

SEQ ID NO: 8981 - protein, 15 aa, HIV-1
WDREINNYTSLIHSL

SEQ ID NO: 8982 - protein, 9 aa, HIV-1
INNYTSLIH

SEQ ID NO: 8983 - protein, 15 aa, HIV-1
WEALKYWWNLLQYWS

SEQ ID NO: 8984 - protein, 9 aa, HIV-1
LKYWWNLLQ

SEQ ID NO: 8985 - protein, 15 aa, HIV-1
WEALKYWWNLLQYWS

SEQ ID NO: 8986 - protein, 9 aa, HIV-1
YWWNLLQYW

SEQ ID NO: 8987 - protein, 15 aa, HIV-1
WFNITNWLWYIKLFI

SEQ ID NO: 8988 - protein, 9 aa, HIV-1
FNITNWLWY

SEQ ID NO: 8989 - protein, 15 aa, HIV-1
WFNITNWLWYIKLFI

SEQ ID NO: 8990 - protein, 9 aa, HIV-1
ITNWLWYIK

SEQ ID NO: 8991 - protein, 15 aa, HIV-1
WFNITNWLWYIKLFI

SEQ ID NO: 8992 - protein, 9 aa, HIV-1
WFNITNWLW

SEQ ID NO: 8993 - protein, 15 aa, HIV-1
WFNSTWSTEGSNNTE

SEQ ID NO: 8994 - protein, 9 aa, HIV-1
FNSTWSTEG

SEQ ID NO: 8995 - protein, 15 aa, HIV-1
WFNSTWSTEGSNNTE

SEQ ID NO: 8996 - protein, 9 aa, HIV-1
NSTWSTEGS

SEQ ID NO: 8997 - protein, 15 aa, HIV-1
WFNSTWSTEGSNNTE

SEQ ID NO: 8998 - protein, 9 aa, HIV-1
WSTEGSNNT

SEQ ID NO: 8999 - protein, 15 aa, HIV-1
WGCSGKLICTTAVPW

SEQ ID NO: 9000 - protein, 9 aa, HIV-1
WGCSGKLIC

SEQ ID NO: 9001 - protein, 15 aa, HIV-1
WGIKQLQARILAVER

SEQ ID NO: 9002 - protein, 9 aa, HIV-1
IKQLQARIL

SEQ ID NO: 9003 - protein, 15 aa, HIV-1
WGTMLLGMLMICSAT

SEQ ID NO: 9004 - protein, 9 aa, HIV-1
LGMLMICSA

SEQ ID NO: 9005 - protein, 15 aa, HIV-1
WGTMLLGMLMICSAT

SEQ ID NO: 9006 - protein, 9 aa, HIV-1
LLGMLMICS

SEQ ID NO: 9007 - protein, 15 aa, HIV-1
WGWRWGTMLLGMLMI

SEQ ID NO: 9008 - protein, 9 aa, HIV-1
WGTMLLGML

SEQ ID NO: 9009 - protein, 15 aa, HIV-1
WGWRWGTMLLGMLMI

SEQ ID NO: 9010 - protein, 9 aa, HIV-1
WRWGTMLLG

SEQ ID NO: 9011 - protein, 15 aa, HIV-1
WKEATTTLFCASDAK

SEQ ID NO: 9012 - protein, 9 aa, HIV-1
WKEATTTLF

SEQ ID NO: 9013 - protein, 15 aa, HIV-1
WLWYIKLFIMIVGGL

SEQ ID NO: 9014 - protein, 9 aa, HIV-1
IKLFIMIVG

SEQ ID NO: 9015 - protein, 15 aa, HIV-1
WLWYIKLFIMIVGGL

SEQ ID NO: 9016 - protein, 9 aa, HIV-1
YIKLFIMIV

SEQ ID NO: 9017 - protein, 15 aa, HIV-1
WMEWDREINNYTSLI

SEQ ID NO: 9018 - protein, 9 aa, HIV-1
MEWDREINN

SEQ ID NO: 9019 - protein, 15 aa, HIV-1
WNASWSNKSLEQIWN

SEQ ID NO: 9020 - protein, 9 aa, HIV-1
WNASWSNKS

SEQ ID NO: 9021 - protein, 15 aa, HIV-1
WNHTTWMEWDREINN

SEQ ID NO: 9022 - protein, 9 aa, HIV-1
WMEWDREIN

SEQ ID NO: 9023 - protein, 15 aa, HIV-1
WNLLQYWSQELKNSA

SEQ ID NO: 9024 - protein, 9 aa, HIV-1
LQYWSQELK

SEQ ID NO: 9025 - protein, 15 aa, HIV-1
WNLLQYWSQELKNSA

SEQ ID NO: 9026 - protein, 9 aa, HIV-1
YWSQELKNS

SEQ ID NO: 9027 - protein, 15 aa, HIV-1
WNNTLKQIASKLREQ

SEQ ID NO: 9028 - protein, 9 aa, HIV-1
LKQIASKLR

SEQ ID NO: 9029 - protein, 15 aa, HIV-1
WNWFNITNWLWYIKL

SEQ ID NO: 9030 - protein, 9 aa, HIV-1
FNITNWLWY

SEQ ID NO: 9031 - protein, 15 aa, HIV-1
WNWFNITNWLWYIKL

SEQ ID NO: 9032 - protein, 9 aa, HIV-1
ITNWLWYIK

SEQ ID NO: 9033 - protein, 15 aa, HIV-1
WNWFNITNWLWYIKL

SEQ ID NO: 9034 - protein, 9 aa, HIV-1
WFNITNWLW

SEQ ID NO: 9035 - protein, 15 aa, HIV-1
WQKVGKAMYAPPISG

SEQ ID NO: 9036 - protein, 9 aa, HIV-1
GKAMYAPPI

SEQ ID NO: 9037 - protein, 15 aa, HIV-1
WRSELYKYKVVKIEP

SEQ ID NO: 9038 - protein, 9 aa, HIV-1
WRSELYKYK

SEQ ID NO: 9039 - protein, 15 aa, HIV-1
WRWGTMLLGMLMICS

SEQ ID NO: 9040 - protein, 9 aa, HIV-1
WGTMLLGML

SEQ ID NO: 9041 - protein, 15 aa, HIV-1
WRWGTMLLGMLMICS

SEQ ID NO: 9042 - protein, 9 aa, HIV-1
WRWGTMLLG

SEQ ID NO: 9043 - protein, 15 aa, HIV-1
WRWGWRWGTMLLGML

SEQ ID NO: 9044 - protein, 9 aa, HIV-1
WGWRWGTML

SEQ ID NO: 9045 - protein, 15 aa, HIV-1
WRWGWRWGTMLLGML

SEQ ID NO: 9046 - protein, 9 aa, HIV-1
WRWGTMLLG

SEQ ID NO: 9047 - protein, 15 aa, HIV-1
WSQELKNSAVSLLNA

SEQ ID NO: 9048 - protein, 9 aa, HIV-1
LKNSAVSLL

SEQ ID NO: 9049 - protein, 15 aa, HIV-1
WVTVYYGVPVWKEAT

SEQ ID NO: 9050 - protein, 9 aa, HIV-1
YYGVPVWKE

SEQ ID NO: 9051 - protein, 15 aa, HIV-1
WWNLLQYWSQELKNS

SEQ ID NO: 9052 - protein, 9 aa, HIV-1
LLQYWSQEL

SEQ ID NO: 9053 - protein, 15 aa, HIV-1
WWNLLQYWSQELKNS

SEQ ID NO: 9054 - protein, 9 aa, HIV-1
LQYWSQELK

SEQ ID NO: 9055 - protein, 15 aa, HIV-1
WYIKLFIMIVGGLVG

SEQ ID NO: 9056 - protein, 9 aa, HIV-1
FIMIVGGLV

SEQ ID NO: 9057 - protein, 15 aa, HIV-1
WYIKLFIMIVGGLVG

SEQ ID NO: 9058 - protein, 9 aa, HIV-1
IKLFIMIVG

SEQ ID NO: 9059 - protein, 15 aa, HIV-1
YAFFYKLDIIPIDND

SEQ ID NO: 9060 - protein, 9 aa, HIV-1
YKLDIIPID

SEQ ID NO: 9061 - protein, 15 aa, HIV-1
YCNSTQLFNSTWFNS

SEQ ID NO: 9062 - protein, 9 aa, HIV-1
TQLFNSTWF

SEQ ID NO: 9063 - protein, 15 aa, HIV-1
YDTEVHNVWATHACV

SEQ ID NO: 9064 - protein, 9 aa, HIV-1
VHNVWATHA

SEQ ID NO: 9065 - protein, 15 aa, HIV-1
YGVPVWKEATTTLFC

SEQ ID NO: 9066 - protein, 9 aa, HIV-1
WKEATTTLF

SEQ ID NO: 9067 - protein, 15 aa, HIV-1
YHRLRDLLLIVTRIV

SEQ ID NO: 9068 - protein, 9 aa, HIV-1
LRDLLLIVT

SEQ ID NO: 9069 - protein, 15 aa, HIV-1
YIKLFIMIVGGLVGL

SEQ ID NO: 9070 - protein, 9 aa, HIV-1
FIMIVGGLV

SEQ ID NO: 9071 - protein, 15 aa, HIV-1
YIKLFIMIVGGLVGL

SEQ ID NO: 9072 - protein, 9 aa, HIV-1
IKLFIMIVG

SEQ ID NO: 9073 - protein, 15 aa, HIV-1
YIKLFIMIVGGLVGL

SEQ ID NO: 9074 - protein, 9 aa, HIV-1
IMIVGGLVG

SEQ ID NO: 9075 - protein, 15 aa, HIV-1
YKLTSCNTSVITQAC

SEQ ID NO: 9076 - protein, 9 aa, HIV-1
LTSCNTSVI

SEQ ID NO: 9077 - protein, 15 aa, HIV-1
YKVVKIEPLGVAPTK

SEQ ID NO: 9078 - protein, 9 aa, HIV-1
IEPLGVAPT

SEQ ID NO: 9079 - protein, 15 aa, HIV-1
YKVVKIEPLGVAPTK

SEQ ID NO: 9080 - protein, 9 aa, HIV-1
VKIEPLGVA

SEQ ID NO: 9081 - protein, 15 aa, HIV-1
YKYKVVKIEPLGVAP

SEQ ID NO: 9082 - protein, 9 aa, HIV-1
VVKIEPLGV

SEQ ID NO: 9083 - protein, 15 aa, HIV-1
YKYKVVKIEPLGVAP

SEQ ID NO: 9084 - protein, 9 aa, HIV-1
YKVVKIEPL

SEQ ID NO: 9085 - protein, 15 aa, HIV-1
YQHLWRWGWRWGTML

SEQ ID NO: 9086 - protein, 9 aa, HIV-1
LWRWGWRWG

SEQ ID NO: 9087 - protein, 15 aa, HIV-1
YQHLWRWGWRWGTML

SEQ ID NO: 9088 - protein, 9 aa, HIV-1
QHLWRWGWR

SEQ ID NO: 9089 - protein, 15 aa, HIV-1
YQHLWRWGWRWGTML

SEQ ID NO: 9090 - protein, 9 aa, HIV-1
WRWGWRWGT

SEQ ID NO: 9091 - protein, 15 aa, HIV-1
YSPLSFQTHLPTPRG

SEQ ID NO: 9092 - protein, 9 aa, HIV-1
FQTHLPTPR

SEQ ID NO: 9093 - protein, 15 aa, HIV-1
YSPLSFQTHLPTPRG

SEQ ID NO: 9094 - protein, 9 aa, HIV-1
SFQTHLPTP

SEQ ID NO: 9095 - protein, 15 aa, HIV-1
YWSQELKNSAVSLLN

SEQ ID NO: 9096 - protein, 9 aa, HIV-1
LKNSAVSLL

SEQ ID NO: 9097 - protein, 15 aa, HIV-1
YWWNLLQYWSQELKN

SEQ ID NO: 9098 - protein, 9 aa, HIV-1
LQYWSQELK

SEQ ID NO: 9099 - protein, 15 aa, HIV-1
YWWNLLQYWSQELKN

SEQ ID NO: 9100 - protein, 9 aa, HIV-1
YWWNLLQYW

SEQ ID NO: 9101 - protein, 15 aa, HIV-1
YYGVPVWKEATTTLF

SEQ ID NO: 9102 - protein, 9 aa, HIV-1
VWKEATTTL

SEQ ID NO: 9103 - protein, 15 aa, HIV-1
YYGVPVWKEATTTLF

SEQ ID NO: 9104 - protein, 9 aa, HIV-1
YYGVPVWKE

SEQ ID NO: 9105 - protein, 15 aa, HIV-1
AAGSTMGAASMTLTV

SEQ ID NO: 9106 - protein, 9 aa, HIV-1
MGAASMTLT

SEQ ID NO: 9107 - protein, 15 aa, HIV-1
AASMTLTVQARQLLS

SEQ ID NO: 9108 - protein, 9 aa, HIV-1
LTVQARQLL

SEQ ID NO: 9109 - protein, 8 aa, HIV-1
GKWSKSSV

SEQ ID NO: 9110 - protein, 8 aa, HIV-1
KWSKSSVI

SEQ ID NO: 9111 - protein, 8 aa, HIV-1
SVIGWPTV

SEQ ID NO: 9112 - protein, 8 aa, HIV-1
VIGWPTVR

SEQ ID NO: 9113 - protein, 8 aa, HIV-1
WPTVRERM

SEQ ID NO: 9114 - protein, 8 aa, HIV-1
TVRERMRR

SEQ ID NO: 9115 - protein, 8 aa, HIV-1
RMRRAEPA

SEQ ID NO: 9116 - protein, 8 aa, HIV-1
AEPAADRV

SEQ ID NO: 9117 - protein, 8 aa, HIV-1
AASRDLEK

SEQ ID NO: 9118 - protein, 8 aa, HIV-1
NTAATNAA

SEQ ID NO: 9119 - protein, 8 aa, HIV-1
ATNAACAW

SEQ ID NO: 9120 - protein, 8 aa, HIV-1
TNAACAWL

SEQ ID NO: 9121 - protein, 8 aa, HIV-1
QEEEEVGF

SEQ ID NO: 9122 - protein, 8 aa, HIV-1
EEEVGFPV

SEQ ID NO: 9123 - protein, 8 aa, HIV-1
EEVGFPVT

SEQ ID NO: 9124 - protein, 8 aa, HIV-1
FPVTPQVP

SEQ ID NO: 9125 - protein, 8 aa, HIV-1
PVTPQVPL

SEQ ID NO: 9126 - protein, 8 aa, HIV-1
VTPQVPLR

SEQ ID NO: 9127 - protein, 8 aa, HIV-1
VPLRPMTY

SEQ ID NO: 9128 - protein, 8 aa, HIV-1
PLRPMTYK

SEQ ID NO: 9129 - protein, 8 aa, HIV-1
RPMTYKAA

SEQ ID NO: 9130 - protein, 8 aa, HIV-1
PMTYKAAV

SEQ ID NO: 9131 - protein, 8 aa, HIV-1
TYKAAVDL

SEQ ID NO: 9132 - protein, 8 aa, HIV-1
AAVDLSHF

SEQ ID NO: 9133 - protein, 8 aa, HIV-1
AVDLSHFL

SEQ ID NO: 9134 - protein, 8 aa, HIV-1
LSHFLKEK

SEQ ID NO: 9135 - protein, 8 aa, HIV-1
FLKEKGGL

SEQ ID NO: 9136 - protein, 8 aa, HIV-1
RRQDILDL

SEQ ID NO: 9137 - protein, 8 aa, HIV-1
DILDLWIY

SEQ ID NO: 9138 - protein, 8 aa, HIV-1
ILDLWIYH

SEQ ID NO: 9139 - protein, 8 aa, HIV-1
DLWIYHTQ

SEQ ID NO: 9140 - protein, 8 aa, HIV-1
WIYHTQGY

SEQ ID NO: 9141 - protein, 8 aa, HIV-1
IYHTQGYF

SEQ ID NO: 9142 - protein, 8 aa, HIV-1
YFPDWQNY

SEQ ID NO: 9143 - protein, 8 aa, HIV-1
FPDWQNYT

SEQ ID NO: 9144 - protein, 8 aa, HIV-1
NYTPGPGV

SEQ ID NO: 9145 - protein, 8 aa, HIV-1
YTPGPGVR

SEQ ID NO: 9146 - protein, 8 aa, HIV-1
TPGPGVRY

SEQ ID NO: 9147 - protein, 8 aa, HIV-1
GPGVRYPL

SEQ ID NO: 9148 - protein, 8 aa, HIV-1
GVRYPLTF

SEQ ID NO: 9149 - protein, 8 aa, HIV-1
RYPLTFGW

SEQ ID NO: 9150 - protein, 8 aa, HIV-1
YPLTFGWC

SEQ ID NO: 9151 - protein, 8 aa, HIV-1
LTFGWCYK

SEQ ID NO: 9152 - protein, 8 aa, HIV-1
TFGWCYKL

SEQ ID NO: 9153 - protein, 8 aa, HIV-1
FGWCYKLV

SEQ ID NO: 9154 - protein, 8 aa, HIV-1
WCYKLVPV

SEQ ID NO: 9155 - protein, 8 aa, HIV-1
VPVEPDKI

SEQ ID NO: 9156 - protein, 8 aa, HIV-1
NTSLLHPV

SEQ ID NO: 9157 - protein, 8 aa, HIV-1
SLLHPVSL

SEQ ID NO: 9158 - protein, 8 aa, HIV-1
LLHPVSLH

SEQ ID NO: 9159 - protein, 8 aa, HIV-1
HPVSLHGM

SEQ ID NO: 9160 - protein, 8 aa, HIV-1
HGMDDPER

SEQ ID NO: 9161 - protein, 8 aa, HIV-1
PEREVLEW

SEQ ID NO: 9162 - protein, 8 aa, HIV-1
REVLEWRF

SEQ ID NO: 9163 - protein, 8 aa, HIV-1
RFDSRLAF

SEQ ID NO: 9164 - protein, 8 aa, HIV-1
SRLAFHHV

SEQ ID NO: 9165 - protein, 8 aa, HIV-1
RLAFHHVA

SEQ ID NO: 9166 - protein, 8 aa, HIV-1
LAFHHVAR

SEQ ID NO: 9167 - protein, 8 aa, HIV-1
FHHVAREL

SEQ ID NO: 9168 - protein, 8 aa, HIV-1
RELHPEYF

SEQ ID NO: 9169 - protein, 8 aa, HIV-1
ELHPEYFK

SEQ ID NO: 9170 - protein, 9 aa, HIV-1
WSKSSVIGW

SEQ ID NO: 9171 - protein, 9 aa, HIV-1
SSVIGWPTV

SEQ ID NO: 9172 - protein, 9 aa, HIV-1
SVIGWPTVR

SEQ ID NO: 9173 - protein, 9 aa, HIV-1
PTVRERMRR

SEQ ID NO: 9174 - protein, 9 aa, HIV-1
TVRERMRRA

SEQ ID NO: 9175 - protein, 9 aa, HIV-1
RMRRAEPAA

SEQ ID NO: 9176 - protein, 9 aa, HIV-1
RRAEPAADR

SEQ ID NO: 9177 - protein, 9 aa, HIV-1
RAEPAADRV

SEQ ID NO: 9178 - protein, 9 aa, HIV-1
EPAADRVGA

SEQ ID NO: 9179 - protein, 9 aa, HIV-1
GAASRDLEK

SEQ ID NO: 9180 - protein, 9 aa, HIV-1
NTAATNAAC

SEQ ID NO: 9181 - protein, 9 aa, HIV-1
TAATNAACA

SEQ ID NO: 9182 - protein, 9 aa, HIV-1
AATNAACAW

SEQ ID NO: 9183 - protein, 9 aa, HIV-1
ATNAACAWL

SEQ ID NO: 9184 - protein, 9 aa, HIV-1
NAACAWLEA

SEQ ID NO: 9185 - protein, 9 aa, HIV-1
AQEEEEVGF

SEQ ID NO: 9186 - protein, 9 aa, HIV-1
EEEEVGFPV

SEQ ID NO: 9187 - protein, 9 aa, HIV-1
VGFPVTPQV

SEQ ID NO: 9188 - protein, 9 aa, HIV-1
FPVTPQVPL

SEQ ID NO: 9189 - protein, 9 aa, HIV-1
PVTPQVPLR

SEQ ID NO: 9190 - protein, 9 aa, HIV-1
TPQVPLRPM

SEQ ID NO: 9191 - protein, 9 aa, HIV-1
QVPLRPMTY

SEQ ID NO: 9192 - protein, 9 aa, HIV-1
VPLRPMTYK

SEQ ID NO: 9193 - protein, 9 aa, HIV-1
PLRPMTYKA

SEQ ID NO: 9194 - protein, 9 aa, HIV-1
RPMTYKAAV

SEQ ID NO: 9195 - protein, 9 aa, HIV-1
MTYKAAVDL

SEQ ID NO: 9196 - protein, 9 aa, HIV-1
KAAVDLSHF

SEQ ID NO: 9197 - protein, 9 aa, HIV-1
AAVDLSHFL

SEQ ID NO: 9198 - protein, 9 aa, HIV-1
AVDLSHFLK

SEQ ID NO: 9199 - protein, 9 aa, HIV-1
DLSHFLKEK

SEQ ID NO: 9200 - protein, 9 aa, HIV-1
HFLKEKGGL

SEQ ID NO: 9201 - protein, 9 aa, HIV-1
KEKGGLEGL

SEQ ID NO: 9202 - protein, 9 aa, HIV-1
GLEGLIHSQ

SEQ ID NO: 9203 - protein, 9 aa, HIV-1
RQDILDLWI

SEQ ID NO: 9204 - protein, 9 aa, HIV-1
ILDLWIYHT

SEQ ID NO: 9205 - protein, 9 aa, HIV-1
LWIYHTQGY

SEQ ID NO: 9206 - protein, 9 aa, HIV-1
WIYHTQGYF

SEQ ID NO: 9207 - protein, 9 aa, HIV-1
HTQGYFPDW

SEQ ID NO: 9208 - protein, 9 aa, HIV-1
GYFPDWQNY

SEQ ID NO: 9209 - protein, 9 aa, HIV-1
FPDWQNYTP

SEQ ID NO: 9210 - protein, 9 aa, HIV-1
NYTPGPGVR

SEQ ID NO: 9211 - protein, 9 aa, HIV-1
YTPGPGVRY

SEQ ID NO: 9212 - protein, 9 aa, HIV-1
VRYPLTFGW

SEQ ID NO: 9213 - protein, 9 aa, HIV-1
YPLTFGWCY

SEQ ID NO: 9214 - protein, 9 aa, HIV-1
PLTFGWCYK

SEQ ID NO: 9215 - protein, 9 aa, HIV-1
LTFGWCYKL

SEQ ID NO: 9216 - protein, 9 aa, HIV-1
KLVPVEPDK

SEQ ID NO: 9217 - protein, 9 aa, HIV-1
ENTSLLHPV

SEQ ID NO: 9218 - protein, 9 aa, HIV-1
GMDDPEREV

SEQ ID NO: 9219 - protein, 9 aa, HIV-1
DPEREVLEW

SEQ ID NO: 9220 - protein, 9 aa, HIV-1
EVLEWRFDS

SEQ ID NO: 9221 - protein, 9 aa, HIV-1
VLEWRFDSR

SEQ ID NO: 9222 - protein, 9 aa, HIV-1
LEWRFDSRL

SEQ ID NO: 9223 - protein, 9 aa, HIV-1
WRFDSRLAF

SEQ ID NO: 9224 - protein, 9 aa, HIV-1
RFDSRLAFH

SEQ ID NO: 9225 - protein, 9 aa, HIV-1
DSRLAFHHV

SEQ ID NO: 9226 - protein, 9 aa, HIV-1
RLAFHHVAR

SEQ ID NO: 9227 - protein, 9 aa, HIV-1
AFHHVAREL

SEQ ID NO: 9228 - protein, 9 aa, HIV-1
VARELHPEY

SEQ ID NO: 9229 - protein, 9 aa, HIV-1
RELHPEYFK

SEQ ID NO: 9230 - protein, 10 aa, HIV-1
KWSKSSVIGW

SEQ ID NO: 9231 - protein, 10 aa, HIV-1
KSSVIGWPTV

SEQ ID NO: 9232 - protein, 10 aa, HIV-1
SSVIGWPTVR

SEQ ID NO: 9233 - protein, 10 aa, HIV-1
VIGWPTVRER

SEQ ID NO: 9234 - protein, 10 aa, HIV-1
AEPAADRVGA

SEQ ID NO: 9235 - protein, 10 aa, HIV-1
EPAADRVGAA

SEQ ID NO: 9236 - protein, 10 aa, HIV-1
NTAATNAACA

SEQ ID NO: 9237 - protein, 10 aa, HIV-1
TAATNAACAW

SEQ ID NO: 9238 - protein, 10 aa, HIV-1
WLEAQEEEEV

SEQ ID NO: 9239 - protein, 10 aa, HIV-1
EAQEEEEVGF

SEQ ID NO: 9240 - protein, 10 aa, HIV-1
EVGFPVTPQV

SEQ ID NO: 9241 - protein, 10 aa, HIV-1
FPVTPQVPLR

SEQ ID NO: 9242 - protein, 10 aa, HIV-1
VTPQVPLRPM

SEQ ID NO: 9243 - protein, 10 aa, HIV-1
PQVPLRPMTY

SEQ ID NO: 9244 - protein, 10 aa, HIV-1
QVPLRPMTYK

SEQ ID NO: 9245 - protein, 10 aa, HIV-1
VPLRPMTYKA

SEQ ID NO: 9246 - protein, 10 aa, HIV-1
PLRPMTYKAA

SEQ ID NO: 9247 - protein, 10 aa, HIV-1
RPMTYKAAVD

SEQ ID NO: 9248 - protein, 10 aa, HIV-1
MTYKAAVDLS

SEQ ID NO: 9249 - protein, 10 aa, HIV-1
KAAVDLSHFL

SEQ ID NO: 9250 - protein, 10 aa, HIV-1
AAVDLSHFLK

SEQ ID NO: 9251 - protein, 10 aa, HIV-1
GLEGLIHSQR

SEQ ID NO: 9252 - protein, 10 aa, HIV-1
IHSQRRQDIL

SEQ ID NO: 9253 - protein, 10 aa, HIV-1
RRQDILDLWI

SEQ ID NO: 9254 - protein, 10 aa, HIV-1
RQDILDLWIY

SEQ ID NO: 9255 - protein, 10 aa, HIV-1
DILDLWIYHT

SEQ ID NO: 9256 - protein, 10 aa, HIV-1
ILDLWIYHTQ

SEQ ID NO: 9257 - protein, 10 aa, HIV-1
DLWIYHTQGY

SEQ ID NO: 9258 - protein, 10 aa, HIV-1
LWIYHTQGYF

SEQ ID NO: 9259 - protein, 10 aa, HIV-1
FPDWQNYTPG

SEQ ID NO: 9260 - protein, 10 aa, HIV-1
WQNYTPGPGV

SEQ ID NO: 9261 - protein, 10 aa, HIV-1
NYTPGPGVRY

SEQ ID NO: 9262 - protein, 10 aa, HIV-1
TPGPGVRYPL

SEQ ID NO: 9263 - protein, 10 aa, HIV-1
GPGVRYPLTF

SEQ ID NO: 9264 - protein, 10 aa, HIV-1
RYPLTFGWCY

SEQ ID NO: 9265 - protein, 10 aa, HIV-1
YPLTFGWCYK

SEQ ID NO: 9266 - protein, 10 aa, HIV-1
PLTFGWCYKL

SEQ ID NO: 9267 - protein, 10 aa, HIV-1
LTFGWCYKLV

SEQ ID NO: 9268 - protein, 10 aa, HIV-1
FGWCYKLVPV

SEQ ID NO: 9269 - protein, 10 aa, HIV-1
KLVPVEPDKI

SEQ ID NO: 9270 - protein, 10 aa, HIV-1
GENTSLLHPV

SEQ ID NO: 9271 - protein, 10 aa, HIV-1
NTSLLHPVSL

SEQ ID NO: 9272 - protein, 10 aa, HIV-1
LLHPVSLHGM

SEQ ID NO: 9273 - protein, 10 aa, HIV-1
SLHGMDDPER

SEQ ID NO: 9274 - protein, 10 aa, HIV-1
HGMDDPEREV

SEQ ID NO: 9275 - protein, 10 aa, HIV-1
GMDDPEREVL

SEQ ID NO: 9276 - protein, 10 aa, HIV-1
PEREVLEWRF

SEQ ID NO: 9277 - protein, 10 aa, HIV-1
EVLEWRFDSR

SEQ ID NO: 9278 - protein, 10 aa, HIV-1
VLEWRFDSRL

SEQ ID NO: 9279 - protein, 10 aa, HIV-1
EWRFDSRLAF

SEQ ID NO: 9280 - protein, 10 aa, HIV-1
WRFDSRLAFH

SEQ ID NO: 9281 - protein, 10 aa, HIV-1
SRLAFHHVAR

SEQ ID NO: 9282 - protein, 10 aa, HIV-1
LAFHHVAREL

SEQ ID NO: 9283 - protein, 10 aa, HIV-1
HVARELHPEY

SEQ ID NO: 9284 - protein, 11 aa, HIV-1
SKSSVIGWPTV

SEQ ID NO: 9285 - protein, 11 aa, HIV-1
KSSVIGWPTVR

SEQ ID NO: 9286 - protein, 11 aa, HIV-1
SVIGWPTVRER

SEQ ID NO: 9287 - protein, 11 aa, HIV-1
WPTVRERMRRA

SEQ ID NO: 9288 - protein, 11 aa, HIV-1
RMRRAEPAADR

SEQ ID NO: 9289 - protein, 11 aa, HIV-1
AEPAADRVGAA

SEQ ID NO: 9290 - protein, 11 aa, HIV-1
EPAADRVGAAS

SEQ ID NO: 9291 - protein, 11 aa, HIV-1
RVGAASRDLEK

SEQ ID NO: 9292 - protein, 11 aa, HIV-1
TSSNTAATNAA

SEQ ID NO: 9293 - protein, 11 aa, HIV-1
NTAATNAACAW

SEQ ID NO: 9294 - protein, 11 aa, HIV-1
TAATNAACAWL

SEQ ID NO: 9295 - protein, 11 aa, HIV-1
LEAQEEEEVGF

SEQ ID NO: 9296 - protein, 11 aa, HIV-1
AQEEEEVGFPV

SEQ ID NO: 9297 - protein, 11 aa, HIV-1
EEVGFPVTPQV

SEQ ID NO: 9298 - protein, 11 aa, HIV-1
FPVTPQVPLRP

SEQ ID NO: 9299 - protein, 11 aa, HIV-1
PVTPQVPLRPM

SEQ ID NO: 9300 - protein, 11 aa, HIV-1
TPQVPLRPMTY

SEQ ID NO: 9301 - protein, 11 aa, HIV-1
QVPLRPMTYKA

SEQ ID NO: 9302 - protein, 11 aa, HIV-1
VPLRPMTYKAA

SEQ ID NO: 9303 - protein, 11 aa, HIV-1
PLRPMTYKAAV

SEQ ID NO: 9304 - protein, 11 aa, HIV-1
RPMTYKAAVDL

SEQ ID NO: 9305 - protein, 11 aa, HIV-1
MTYKAAVDLSH

SEQ ID NO: 9306 - protein, 11 aa, HIV-1
TYKAAVDLSHF

SEQ ID NO: 9307 - protein, 11 aa, HIV-1
YKAAVDLSHFL

SEQ ID NO: 9308 - protein, 11 aa, HIV-1
KAAVDLSHFLK

SEQ ID NO: 9309 - protein, 11 aa, HIV-1
AVDLSHFLKEK

SEQ ID NO: 9310 - protein, 11 aa, HIV-1
FLKEKGGLEGL

SEQ ID NO: 9311 - protein, 11 aa, HIV-1
GLIHSQRRQDI

SEQ ID NO: 9312 - protein, 11 aa, HIV-1
RRQDILDLWIY

SEQ ID NO: 9313 - protein, 11 aa, HIV-1
DILDLWIYHTQ

SEQ ID NO: 9314 - protein, 11 aa, HIV-1
ILDLWIYHTQG

SEQ ID NO: 9315 - protein, 11 aa, HIV-1
LDLWIYHTQGY

SEQ ID NO: 9316 - protein, 11 aa, HIV-1
IYHTQGYFPDW

SEQ ID NO: 9317 - protein, 11 aa, HIV-1
FPDWQNYTPGP

SEQ ID NO: 9318 - protein, 11 aa, HIV-1
WQNYTPGPGVR

SEQ ID NO: 9319 - protein, 11 aa, HIV-1
YTPGPGVRYPL

SEQ ID NO: 9320 - protein, 11 aa, HIV-1
VRYPLTFGWCY

SEQ ID NO: 9321 - protein, 11 aa, HIV-1
RYPLTFGWCYK

SEQ ID NO: 9322 - protein, 11 aa, HIV-1
YPLTFGWCYKL

SEQ ID NO: 9323 - protein, 11 aa, HIV-1
PLTFGWCYKLV

SEQ ID NO: 9324 - protein, 11 aa, HIV-1
CYKLVPVEPDK

SEQ ID NO: 9325 - protein, 11 aa, HIV-1
VPVEPDKIEEA

SEQ ID NO: 9326 - protein, 11 aa, HIV-1
SLLHPVSLHGM

SEQ ID NO: 9327 - protein, 11 aa, HIV-1
HGMDDPEREVL

SEQ ID NO: 9328 - protein, 11 aa, HIV-1
GMDDPEREVLE

SEQ ID NO: 9329 - protein, 11 aa, HIV-1
DPEREVLEWRF

SEQ ID NO: 9330 - protein, 11 aa, HIV-1
EVLEWRFDSRL

SEQ ID NO: 9331 - protein, 11 aa, HIV-1
VLEWRFDSRLA

SEQ ID NO: 9332 - protein, 11 aa, HIV-1
LEWRFDSRLAF

SEQ ID NO: 9333 - protein, 11 aa, HIV-1
WRFDSRLAFHH

SEQ ID NO: 9334 - protein, 11 aa, HIV-1
RFDSRLAFHHV

SEQ ID NO: 9335 - protein, 11 aa, HIV-1
DSRLAFHHVAR

SEQ ID NO: 9336 - protein, 11 aa, HIV-1
RLAFHHVAREL

SEQ ID NO: 9337 - protein, 11 aa, HIV-1
HVARELHPEYF

SEQ ID NO: 9338 - protein, 11 aa, HIV-1
VARELHPEYFK

SEQ ID NO: 9339 - protein, 15 aa, HIV-1
ADRVGAASRDLEKHG

SEQ ID NO: 9340 - protein, 9 aa, HIV-1
RVGAASRDL

SEQ ID NO: 9341 - protein, 15 aa, HIV-1
AEPAADRVGAASRDL

SEQ ID NO: 9342 - protein, 9 aa, HIV-1
AADRVGAAS

SEQ ID NO: 9343 - protein, 15 aa, HIV-1
AITSSNTAATNAACA

SEQ ID NO: 9344 - protein, 9 aa, HIV-1
ITSSNTAAT

SEQ ID NO: 9345 - protein, 15 aa, HIV-1
ASRDLEKHGAITSSN

SEQ ID NO: 9346 - protein, 9 aa, HIV-1
LEKHGAITS

SEQ ID NO: 9347 - protein, 15 aa, HIV-1
CYKLVPVEPDKIEEA

SEQ ID NO: 9348 - protein, 9 aa, HIV-1
YKLVPVEPD

SEQ ID NO: 9349 - protein, 15 aa, HIV-1
DDPEREVLEWRFDSR

SEQ ID NO: 9350 - protein, 9 aa, HIV-1
PEREVLEWR

SEQ ID NO: 9351 - protein, 15 aa, HIV-1
DLEKHGAITSSNTAA

SEQ ID NO: 9352 - protein, 9 aa, HIV-1
LEKHGAITS

SEQ ID NO: 9353 - protein, 15 aa, HIV-1
DPEREVLEWRFDSRL

SEQ ID NO: 9354 - protein, 9 aa, HIV-1
VLEWRFDSR

SEQ ID NO: 9355 - protein, 15 aa, HIV-1
DSRLAFHHVARELHP

SEQ ID NO: 9356 - protein, 9 aa, HIV-1
FHHVARELH

SEQ ID NO: 9357 - protein, 15 aa, HIV-1
DWQNYTPGPGVRYPL

SEQ ID NO: 9358 - protein, 9 aa, HIV-1
YTPGPGVRY

SEQ ID NO: 9359 - protein, 15 aa, HIV-1
EEVGFPVTPQVPLRP

SEQ ID NO: 9360 - protein, 9 aa, HIV-1
GFPVTPQVP

SEQ ID NO: 9361 - protein, 15 aa, HIV-1
EEVGFPVTPQVPLRP

SEQ ID NO: 9362 - protein, 9 aa, HIV-1
VGFPVTPQV

SEQ ID NO: 9363 - protein, 15 aa, HIV-1
EKHGAITSSNTAATN

SEQ ID NO: 9364 - protein, 9 aa, HIV-1
ITSSNTAAT

SEQ ID NO: 9365 - protein, 15 aa, HIV-1
ENTSLLHPVSLHGMD

SEQ ID NO: 9366 - protein, 9 aa, HIV-1
LHPVSLHGM

SEQ ID NO: 9367 - protein, 15 aa, HIV-1
ENTSLLHPVSLHGMD

SEQ ID NO: 9368 - protein, 9 aa, HIV-1
LLHPVSLHG

SEQ ID NO: 9369 - protein, 15 aa, HIV-1
EPAADRVGAASRDLE

SEQ ID NO: 9370 - protein, 9 aa, HIV-1
RVGAASRDL

SEQ ID NO: 9371 - protein, 15 aa, HIV-1
EREVLEWRFDSRLAF

SEQ ID NO: 9372 - protein, 9 aa, HIV-1
LEWRFDSRL

SEQ ID NO: 9373 - protein, 15 aa, HIV-1
EREVLEWRFDSRLAF

SEQ ID NO: 9374 - protein, 9 aa, HIV-1
VLEWRFDSR

SEQ ID NO: 9375 - protein, 15 aa, HIV-1
ERMRRAEPAADRVGA

SEQ ID NO: 9376 - protein, 9 aa, HIV-1
MRRAEPAAD

SEQ ID NO: 9377 - protein, 15 aa, HIV-1
EVGFPVTPQVPLRPM

SEQ ID NO: 9378 - protein, 9 aa, HIV-1
VTPQVPLRP

SEQ ID NO: 9379 - protein, 15 aa, HIV-1
EVLEWRFDSRLAFHH

SEQ ID NO: 9380 - protein, 9 aa, HIV-1
VLEWRFDSR

SEQ ID NO: 9381 - protein, 15 aa, HIV-1
EVLEWRFDSRLAFHH

SEQ ID NO: 9382 - protein, 9 aa, HIV-1
WRFDSRLAF

SEQ ID NO: 9383 - protein, 15 aa, HIV-1
EWRFDSRLAFHHVAR

SEQ ID NO: 9384 - protein, 9 aa, HIV-1
WRFDSRLAF

SEQ ID NO: 9385 - protein, 15 aa, HIV-1
FDSRLAFHHVARELH

SEQ ID NO: 9386 - protein, 9 aa, HIV-1
FDSRLAFHH

SEQ ID NO: 9387 - protein, 15 aa, HIV-1
FGWCYKLVPVEPDKI

SEQ ID NO: 9388 - protein, 9 aa, HIV-1
YKLVPVEPD

SEQ ID NO: 9389 - protein, 15 aa, HIV-1
FPDWQNYTPGPGVRY

SEQ ID NO: 9390 - protein, 9 aa, HIV-1
FPDWQNYTP

SEQ ID NO: 9391 - protein, 15 aa, HIV-1
FPDWQNYTPGPGVRY

SEQ ID NO: 9392 - protein, 9 aa, HIV-1
WQNYTPGPG

SEQ ID NO: 9393 - protein, 15 aa, HIV-1
FPVTPQVPLRPMTYK

SEQ ID NO: 9394 - protein, 9 aa, HIV-1
VTPQVPLRP

SEQ ID NO: 9395 - protein, 15 aa, HIV-1
GAITSSNTAATNAAC

SEQ ID NO: 9396 - protein, 9 aa, HIV-1
ITSSNTAAT

SEQ ID NO: 9397 - protein, 15 aa, HIV-1
GENTSLLHPVSLHGM

SEQ ID NO: 9398 - protein, 9 aa, HIV-1
LLHPVSLHG

SEQ ID NO: 9399 - protein, 15 aa, HIV-1
GFPVTPQVPLRPMTY

SEQ ID NO: 9400 - protein, 9 aa, HIV-1
VTPQVPLRP

SEQ ID NO: 9401 - protein, 15 aa, HIV-1
GWCYKLVPVEPDKIE

SEQ ID NO: 9402 - protein, 9 aa, HIV-1
YKLVPVEPD

SEQ ID NO: 9403 - protein, 15 aa, HIV-1
GYFPDWQNYTPGPGV

SEQ ID NO: 9404 - protein, 9 aa, HIV-1
FPDWQNYTP

SEQ ID NO: 9405 - protein, 15 aa, HIV-1
GYFPDWQNYTPGPGV

SEQ ID NO: 9406 - protein, 9 aa, HIV-1
WQNYTPGPG

SEQ ID NO: 9407 - protein, 15 aa, HIV-1
HGAITSSNTAATNAA

SEQ ID NO: 9408 - protein, 9 aa, HIV-1
ITSSNTAAT

SEQ ID NO: 9409 - protein, 15 aa, HIV-1
HTQGYFPDWQNYTPG

SEQ ID NO: 9410 - protein, 9 aa, HIV-1
QGYFPDWQN

SEQ ID NO: 9411 - protein, 15 aa, HIV-1
HTQGYFPDWQNYTPG

SEQ ID NO: 9412 - protein, 9 aa, HIV-1
YFPDWQNYT

SEQ ID NO: 9413 - protein, 15 aa, HIV-1
ITSSNTAATNAACAW

SEQ ID NO: 9414 - protein, 9 aa, HIV-1
ITSSNTAAT

SEQ ID NO: 9415 - protein, 15 aa, HIV-1
IYHTQGYFPDWQNYT

SEQ ID NO: 9416 - protein, 9 aa, HIV-1
GYFPDWQNY

SEQ ID NO: 9417 - protein, 15 aa, HIV-1
IYHTQGYFPDWQNYT

SEQ ID NO: 9418 - protein, 9 aa, HIV-1
QGYFPDWQN

SEQ ID NO: 9419 - protein, 15 aa, HIV-1
KGENTSLLHPVSLHG

SEQ ID NO: 9420 - protein, 9 aa, HIV-1
NTSLLHPVS

SEQ ID NO: 9421 - protein, 15 aa, HIV-1
KGENTSLLHPVSLHG

SEQ ID NO: 9422 - protein, 9 aa, HIV-1
SLLHPVSLH

SEQ ID NO: 9423 - protein, 15 aa, HIV-1
KHGAITSSNTAATNA

SEQ ID NO: 9424 - protein, 9 aa, HIV-1
ITSSNTAAT

SEQ ID NO: 9425 - protein, 15 aa, HIV-1
KSSVIGWPTVRERMR

SEQ ID NO: 9426 - protein, 9 aa, HIV-1
VIGWPTVRE

SEQ ID NO: 9427 - protein, 15 aa, HIV-1
KWSKSSVIGWPTVRE

SEQ ID NO: 9428 - protein, 9 aa, HIV-1
KSSVIGWPT

SEQ ID NO: 9429 - protein, 15 aa, HIV-1
KWSKSSVIGWPTVRE

SEQ ID NO: 9430 - protein, 9 aa, HIV-1
KWSKSSVIG

SEQ ID NO: 9431 - protein, 15 aa, HIV-1
LAFHHVARELHPEYF

SEQ ID NO: 9432 - protein, 9 aa, HIV-1
FHHVARELH

SEQ ID NO: 9433 - protein, 15 aa, HIV-1
LEKHGAITSSNTAAT

SEQ ID NO: 9434 - protein, 9 aa, HIV-1
GAITSSNTA

SEQ ID NO: 9435 - protein, 15 aa, HIV-1
LEKHGAITSSNTAAT

SEQ ID NO: 9436 - protein, 9 aa, HIV-1
HGAITSSNT

SEQ ID NO: 9437 - protein, 15 aa, HIV-1
LEWRFDSRLAFHHVA

SEQ ID NO: 9438 - protein, 9 aa, HIV-1
WRFDSRLAF

SEQ ID NO: 9439 - protein, 15 aa, HIV-1
LHPVSLHGMDDPERE

SEQ ID NO: 9440 - protein, 9 aa, HIV-1
LHGMDDPER

SEQ ID NO: 9441 - protein, 15 aa, HIV-1
LHPVSLHGMDDPERE

SEQ ID NO: 9442 - protein, 9 aa, HIV-1
LHPVSLHGM

SEQ ID NO: 9443 - protein, 15 aa, HIV-1
LLHPVSLHGMDDPER

SEQ ID NO: 9444 - protein, 9 aa, HIV-1
LHPVSLHGM

SEQ ID NO: 9445 - protein, 15 aa, HIV-1
LLHPVSLHGMDDPER

SEQ ID NO: 9446 - protein, 9 aa, HIV-1
LLHPVSLHG

SEQ ID NO: 9447 - protein, 15 aa, HIV-1
LRPMTYKAAVDLSHF

SEQ ID NO: 9448 - protein, 9 aa, HIV-1
MTYKAAVDL

SEQ ID NO: 9449 - protein, 15 aa, HIV-1
LTFGWCYKLVPVEPD

SEQ ID NO: 9450 - protein, 9 aa, HIV-1
GWCYKLVPV

SEQ ID NO: 9451 - protein, 15 aa, HIV-1
MGGKWSKSSVIGWPT

SEQ ID NO: 9452 - protein, 9 aa, HIV-1
MGGKWSKSS

SEQ ID NO: 9453 - protein, 15 aa, HIV-1
MTYKAAVDLSHFLKE

SEQ ID NO: 9454 - protein, 9 aa, HIV-1
MTYKAAVDL

SEQ ID NO: 9455 - protein, 15 aa, HIV-1
NTSLLHPVSLHGMDD

SEQ ID NO: 9456 - protein, 9 aa, HIV-1
LHPVSLHGM

SEQ ID NO: 9457 - protein, 15 aa, HIV-1
NTSLLHPVSLHGMDD

SEQ ID NO: 9458 - protein, 9 aa, HIV-1
LLHPVSLHG

SEQ ID NO: 9459 - protein, 15 aa, HIV-1
NYTPGPGVRYPLTFG

SEQ ID NO: 9460 - protein, 9 aa, HIV-1
YTPGPGVRY

SEQ ID NO: 9461 - protein, 15 aa, HIV-1
PDWQNYTPGPGVRYP

SEQ ID NO: 9462 - protein, 9 aa, HIV-1
WQNYTPGPG

SEQ ID NO: 9463 - protein, 15 aa, HIV-1
PDWQNYTPGPGVRYP

SEQ ID NO: 9464 - protein, 9 aa, HIV-1
YTPGPGVRY

SEQ ID NO: 9465 - protein, 15 aa, HIV-1
PEREVLEWRFDSRLA

SEQ ID NO: 9466 - protein, 9 aa, HIV-1
VLEWRFDSR

SEQ ID NO: 9467 - protein, 15 aa, HIV-1
PLRPMTYKAAVDLSH

SEQ ID NO: 9468 - protein, 9 aa, HIV-1
MTYKAAVDL

SEQ ID NO: 9469 - protein, 15 aa, HIV-1
PMTYKAAVDLSHFLK

SEQ ID NO: 9470 - protein, 9 aa, HIV-1
MTYKAAVDL

SEQ ID NO: 9471 - protein, 15 aa, HIV-1
PQVPLRPMTYKAAVD

SEQ ID NO: 9472 - protein, 9 aa, HIV-1
LRPMTYKAA

SEQ ID NO: 9473 - protein, 15 aa, HIV-1
PTVRERMRRAEPAAD

SEQ ID NO: 9474 - protein, 9 aa, HIV-1
ERMRRAEPA

SEQ ID NO: 9475 - protein, 15 aa, HIV-1
PVTPQVPLRPMTYKA

SEQ ID NO: 9476 - protein, 9 aa, HIV-1
VPLRPMTYK

SEQ ID NO: 9477 - protein, 15 aa, HIV-1
PVTPQVPLRPMTYKA

SEQ ID NO: 9478 - protein, 9 aa, HIV-1
VTPQVPLRP

SEQ ID NO: 9479 - protein, 15 aa, HIV-1
PAADRVGAASRDLEK

SEQ ID NO: 9480 - protein, 9 aa, HIV-1
RVGAASRDL

SEQ ID NO: 9481 - protein, 15 aa, HIV-1
QGYFPDWQNYTPGPG

SEQ ID NO: 9482 - protein, 9 aa, HIV-1
QGYFPDWQN

SEQ ID NO: 9483 - protein, 15 aa, HIV-1
QGYFPDWQNYTPGPG

SEQ ID NO: 9484 - protein, 9 aa, HIV-1
YFPDWQNYT

SEQ ID NO: 9485 - protein, 15 aa, HIV-1
QNYTPGPGVRYPLTF

SEQ ID NO: 9486 - protein, 9 aa, HIV-1
YTPGPGVRY

SEQ ID NO: 9487 - protein, 15 aa, HIV-1
QVPLRPMTYKAAVDL

SEQ ID NO: 9488 - protein, 9 aa, HIV-1
LRPMTYKAA

SEQ ID NO: 9489 - protein, 15 aa, HIV-1
RDLEKHGAITSSNTA

SEQ ID NO: 9490 - protein, 9 aa, HIV-1
LEKHGAITS

SEQ ID NO: 9491 - protein, 15 aa, HIV-1
RERMRRAEPAADRVG

SEQ ID NO: 9492 - protein, 9 aa, HIV-1
MRRAEPAAD

SEQ ID NO: 9493 - protein, 15 aa, HIV-1
REVLEWRFDSRLAFH

SEQ ID NO: 9494 - protein, 9 aa, HIV-1
VLEWRFDSR

SEQ ID NO: 9495 - protein, 15 aa, HIV-1
REVLEWRFDSRLAFH

SEQ ID NO: 9496 - protein, 9 aa, HIV-1
WRFDSRLAF

SEQ ID NO: 9497 - protein, 15 aa, HIV-1
RLAFHHVARELHPEY

SEQ ID NO: 9498 - protein, 9 aa, HIV-1
FHHVARELH

SEQ ID NO: 9499 - protein, 15 aa, HIV-1
RPMTYKAAVDLSHFL

SEQ ID NO: 9500 - protein, 9 aa, HIV-1
MTYKAAVDL

SEQ ID NO: 9501 - protein, 15 aa, HIV-1
SKSSVIGWPTVRERM

SEQ ID NO: 9502 - protein, 9 aa, HIV-1
VIGWPTVRE

SEQ ID NO: 9503 - protein, 15 aa, HIV-1
SLLHPVSLHGMDDPE

SEQ ID NO: 9504 - protein, 9 aa, HIV-1
LHPVSLHGM

SEQ ID NO: 9505 - protein, 15 aa, HIV-1
SLLHPVSLHGMDDPE

SEQ ID NO: 9506 - protein, 9 aa, HIV-1
LLHPVSLHG

SEQ ID NO: 9507 - protein, 15 aa, HIV-1
SRDLEKHGAITSSNT

SEQ ID NO: 9508 - protein, 9 aa, HIV-1
LEKHGAITS

SEQ ID NO: 9509 - protein, 15 aa, HIV-1
SRLAFHHVARELHPE

SEQ ID NO: 9510 - protein, 9 aa, HIV-1
FHHVARELH

SEQ ID NO: 9511 - protein, 15 aa, HIV-1
SSVIGWPTVRERMRR

SEQ ID NO: 9512 - protein, 9 aa, HIV-1
VIGWPTVRE

SEQ ID NO: 9513 - protein, 15 aa, HIV-1
SVIGWPTVRERMRRA

SEQ ID NO: 9514 - protein, 9 aa, HIV-1
VIGWPTVRE

SEQ ID NO: 9515 - protein, 15 aa, HIV-1
TFGWCYKLVPVEPDK

SEQ ID NO: 9516 - protein, 9 aa, HIV-1
YKLVPVEPD

SEQ ID NO: 9517 - protein, 15 aa, HIV-1
TPQVPLRPMTYKAAV

SEQ ID NO: 9518 - protein, 9 aa, HIV-1
LRPMTYKAA

SEQ ID NO: 9519 - protein, 15 aa, HIV-1
TPQVPLRPMTYKAAV

SEQ ID NO: 9520 - protein, 9 aa, HIV-1
VPLRPMTYK

SEQ ID NO: 9521 - protein, 15 aa, HIV-1
TQGYFPDWQNYTPGP

SEQ ID NO: 9522 - protein, 9 aa, HIV-1
QGYFPDWQN

SEQ ID NO: 9523 - protein, 15 aa, HIV-1
TQGYFPDWQNYTPGP

SEQ ID NO: 9524 - protein, 9 aa, HIV-1
YFPDWQNYT

SEQ ID NO: 9525 - protein, 15 aa, HIV-1
TSLLHPVSLHGMDDP

SEQ ID NO: 9526 - protein, 9 aa, HIV-1
LHPVSLHGM

SEQ ID NO: 9527 - protein, 15 aa, HIV-1
TSLLHPVSLHGMDDP

SEQ ID NO: 9528 - protein, 9 aa, HIV-1
LLHPVSLHG

SEQ ID NO: 9529 - protein, 15 aa, HIV-1
TVRERMRRAEPAADR

SEQ ID NO: 9530 - protein, 9 aa, HIV-1
MRRAEPAAD

SEQ ID NO: 9531 - protein, 15 aa, HIV-1
VGFPVTPQVPLRPMT

SEQ ID NO: 9532 - protein, 9 aa, HIV-1
VTPQVPLRP

SEQ ID NO: 9533 - protein, 15 aa, HIV-1
VIGWPTVRERMRRAE

SEQ ID NO: 9534 - protein, 9 aa, HIV-1
VIGWPTVRE

SEQ ID NO: 9535 - protein, 15 aa, HIV-1
VLEWRFDSRLAFHHV

SEQ ID NO: 9536 - protein, 9 aa, HIV-1
VLEWRFDSR

SEQ ID NO: 9537 - protein, 15 aa, HIV-1
VLEWRFDSRLAFHHV

SEQ ID NO: 9538 - protein, 9 aa, HIV-1
WRFDSRLAF

SEQ ID NO: 9539 - protein, 15 aa, HIV-1
VPLRPMTYKAAVDLS

SEQ ID NO: 9540 - protein, 9 aa, HIV-1
LRPMTYKAA

SEQ ID NO: 9541 - protein, 15 aa, HIV-1
VRERMRRAEPAADRV

SEQ ID NO: 9542 - protein, 9 aa, HIV-1
MRRAEPAAD

SEQ ID NO: 9543 - protein, 15 aa, HIV-1
VTPQVPLRPMTYKAA

SEQ ID NO: 9544 - protein, 9 aa, HIV-1
VPLRPMTYK

SEQ ID NO: 9545 - protein, 15 aa, HIV-1
VTPQVPLRPMTYKAA

SEQ ID NO: 9546 - protein, 9 aa, HIV-1
VTPQVPLRP

SEQ ID NO: 9547 - protein, 15 aa, HIV-1
WCYKLVPVEPDKIEE

SEQ ID NO: 9548 - protein, 9 aa, HIV-1
YKLVPVEPD

SEQ ID NO: 9549 - protein, 15 aa, HIV-1
WQNYTPGPGVRYPLT

SEQ ID NO: 9550 - protein, 9 aa, HIV-1
YTPGPGVRY

SEQ ID NO: 9551 - protein, 15 aa, HIV-1
WRFDSRLAFHHVARE

SEQ ID NO: 9552 - protein, 9 aa, HIV-1
WRFDSRLAF

SEQ ID NO: 9553 - protein, 15 aa, HIV-1
WSKSSVIGWPTVRER

SEQ ID NO: 9554 - protein, 9 aa, HIV-1
VIGWPTVRE

SEQ ID NO: 9555 - protein, 15 aa, HIV-1
YFPDWQNYTPGPGVR

SEQ ID NO: 9556 - protein, 9 aa, HIV-1
WQNYTPGPG

SEQ ID NO: 9557 - protein, 15 aa, HIV-1
YHTQGYFPDWQNYTP

SEQ ID NO: 9558 - protein, 9 aa, HIV-1
QGYFPDWQN

SEQ ID NO: 9559 - protein, 15 aa, HIV-1
YHTQGYFPDWQNYTP

SEQ ID NO: 9560 - protein, 9 aa, HIV-1
YFPDWQNYT

SEQ ID NO: 9561 - protein, 15 aa, HIV-1
YKLVPVEPDKIEEAN

SEQ ID NO: 9562 - protein, 9 aa, HIV-1
YKLVPVEPD

SEQ ID NO: 9563 - protein, 15 aa, HIV-1
YTPGPGVRYPLTFGW

SEQ ID NO: 9564 - protein, 9 aa, HIV-1
YTPGPGVRY

SEQ ID NO: 9565 - protein, 15 aa, HIV-1
AADRVGAASRDLEKH

SEQ ID NO: 9566 - protein, 9 aa, HIV-1
RVGAASRDL

SEQ ID NO: 9567 - protein, 15 aa, HIV-1
AASRDLEKHGAITSS

SEQ ID NO: 9568 - protein, 9 aa, HIV-1
LEKHGAITS

SEQ ID NO: 9569 - protein, 9 aa, Macaca mulatta
CTPYDINQM

SEQ ID NO: 9570 - protein, 8 aa, Macaca mulatta
KPCVKLTP

SEQ ID NO: 9571 - protein, 9 aa, Macaca mulatta
IRFPKTFGW

SEQ ID NO: 9572 - protein, 15 aa, Macaca mulatta
EFVRFDSAVGEYRAV

SEQ ID NO: 9573 - protein, 15 aa, Macaca mulatta
EFVGFDSYLGVYRPV

SEQ ID NO: 9574 - protein, 17 aa, Macaca mulatta
TREDILERERAQVDTFY

SEQ ID NO: 9575 - protein, 9 aa, Homo sapiens
IVDCLTEMY

SEQ ID NO: 9576 - protein, 9 aa, Homo sapiens
GLIQLVEGV

SEQ ID NO: 9577 - protein, 9 aa, Homo sapiens
RIAAWMATY

SEQ ID NO: 9578 - protein, 9 aa, Homo sapiens
IVTDFSVIK

SEQ ID NO: 9579 - protein, 20 aa, Homo sapiens
MNYQVSSPIYNINYYTSEPC

SEQ ID NO: 9580 - protein, 15 aa, Homo sapiens
HYAAAQWNFGNTMCQ

SEQ ID NO: 9581 - protein, 20 aa, Homo sapiens
YSSHFPYSQYQFWKNFQTLK

SEQ ID NO: 9582 - protein, 259 aa, Homo sapiens
LLQDFFNGRELNKSINPDEAVAYGAAVQAAILMGDTSGNVQDLLLLDVAPLSLGIETAGGVMTALIKRNTTIPTKQTQTFTTYSDNQPGVLIQVFEGERAMTKDNNLLGKFELTGIPPAPRGVPQIEVTFDIDANGILNVSAADKSTGKQNKITITNDKGRLSKEEIERMVQEADMYKAEDDLQREKISAKNSLESYAFNMKSSVEDDNLKGKISEEDKKRVIEKCNEAVSWLENNQLADKEEYEHQLKELEKVCNPVI

SEQ ID NO: 9583 - protein, 696 aa, HIV
MPMGSLQPLATLYLLGMLVASVLAVEQLWVTVYYGVPVWKEATTTLFCASDAKAYDTEVHNVWATHACVPTDPNPQEVKLENVTENFNMWKNNMVEQMHEDIISLWDQSLKPCVKLTPLCVTLNCTDLRNATNTTSSSWETMEKGEIKNCSFNITTSIRDKVQKEYALFYNLDVVPIDNASYRLISCNTSVITQACPKVSFEPIPIHYCAPAGFAILKCNDKKFNGTGPCTNVSTVQCTHGIRPVVSTQLLLNGSLAEEEIVIRSENFTNNAKTIIVQLNESVVINCTRPNNNTRKSINIGPGRALYTTGEIIGDIRQAHCNLSKTQWENTLEQIAIKLKEQFGNNKTIIFNPSSGGDPEIVTHSFNCGGEFFYCNSTQLFTWNDTRKLNNTGRNITLPCRIKQIINMWQEVGKAMYAPPIRGQIRCSSNITGLLLTRDGGKDTNGTEIFRPGGGDMRDNWRSELYKYKVVKIEPLGVAPTKAKRRVVQSEKSAVGLGALFLGFLGAAGSTMGAASITLTVQARQLLSGIVQQQNNLLRAIEAQQHLLQLTVWGIKQLQARVLAVERYLRDQQLLGIWGCSGKLICTTTVPWNTSWSNKSLNEIWDNMTWMKWEREIDNYTHIIYSLIEQSQNQQEKNEQELLALDKWASLWNWFDITKWLWYIKGSGYIPEAPRDGQAYVRKDGEWVLLSTFLPP

SEQ ID NO: 9584 - protein, 140 aa, SIV
WVKLVEEKKFGAEVVPGFQALSGGCTPYDINQMLNCVGEHQAAMQIIREIINEEAADWDLQHPQPGPIPAGQLRDPRGSDIAGTTSTVEEQIQWMYRQQNPIPVGNIYRRWIQLGLQKCVRMYNPTNILDVKQGPKEPFQ

SEQ ID NO: 9585 - protein, 15 aa, Homo sapiens
RFLELLKSECHFFNG

SEQ ID NO: 9586 - protein, 15 aa, Homo sapiens
RVWNLIRYIYNQEEY

SEQ ID NO: 9587 - protein, 14 aa, Homo sapiens
FLQQDKYECHFFNG

SEQ ID NO: 9588 - protein, 9 aa, Homo sapiens
IVDCLTEMY

SEQ ID NO: 9589 - protein, 9 aa, EBV
IVTDFSVIK

SEQ ID NO: 9590 - protein, 9 aa, Homo sapiens
GLIQLVEGV

SEQ ID NO: 9591 - protein, 9 aa, Homo sapiens
RIAAWMATY

SEQ ID NO: 9592 - protein, 9 aa, Homo sapiens
EYRALQLHL

SEQ ID NO: 9593 - protein, 9 aa, Homo sapiens
YLAPDNVIT

SEQ ID NO: 9594 - protein, 9 aa, Homo sapiens
YSDEIDIIH

SEQ ID NO: 9595 - protein, 9 aa, Homo sapiens
APDNVITST

SEQ ID NO: 9596 - protein, 15 aa, Homo sapiens
IELVLKESSSNSYLS

SEQ ID NO: 9597 - protein, 15 aa, Homo sapiens
MNKILLLILLESIVF

SEQ ID NO: 9598 - protein, 15 aa, Homo sapiens
SDLIWLIGYRFSDVA

The invention claimed is:

1. An immunogenic composition for producing an immune response against HIV infection comprising one or more biologically active molecules attached to one or more multimerization domains, which do not include membranes, selected from the group consisting of polymers and solid supports, wherein the one or more biologically active molecules comprise:
   i) one or more MHC class I complexes and/or one or more MHC class II complexes attached to the one or more multimerization domains, each optionally loaded with a peptide epitope to form one or more MHC class I-peptide complexes and/or one or more MHC class II-peptide complexes; and, separately,
   ii) one or more HIV-derived proteins attached to the one or more multimerization domains, wherein said HIV-derived proteins are each selected from the group consisting of gp41, gp120, gp140, gp27, and recombinant forms thereof.

2. The immunogenic composition according to claim 1, wherein the one or more biologically active molecules further comprise
   iii) one or more immunologically active molecules attached to the one or more multimerization domains.

3. The immunogenic composition according to claim 1, wherein the one or more multimerization domain(s) comprise a soluble polysaccharide carrier molecule.

4. The immunogenic composition according to claim 1, wherein the composition further comprises one or more immunological adjuvant(s), wherein said one or more immunological adjuvant(s) are able to enhance or facilitate an immune response.

5. The immunogenic composition according to claim 1, wherein the composition further comprises one or more living virulent organism(s).

6. A method for producing an immune response against HIV infection comprising administration to an individual in need thereof an effective amount of the immunogenic composition according to claim 1.

7. A kit-of-parts comprising the immunogenic composition according to claim 1 and at least one additional component.

8. A method for vaccination against HIV infection comprising administration to an individual in need thereof an effective amount of the immunogenic composition of the kit of parts according to claim 7.

9. The immunogenic composition according to claim 1, wherein the one or more HIV-derived proteins selected from the group consisting of gp41, gp 120, gp 140, gp27, and recombinant forms thereof are selected from the group consisting of full length HIV proteins, truncated HIV proteins, and non-truncated but modified HIV proteins.

10. The immunogenic composition according to claim 1, wherein the one or more HIV-derived proteins are selected from the group consisting of gp140 and gp27, and recombinant forms thereof.

11. The immunogenic composition according to claim 2, wherein the one or more immunologically active molecules are selected from the group consisting of heat shock proteins, Hsp70, Hsp90, fragments of Hsp70, C-terminal fragments of Hsp70, recombinant HSP70pep3Bio fragment consisting of amino acid residues 359-609 of Hsp70 as shown in SEQ ID NO: 9582, MHC class I proteins, MHC class I-like peptides, MHC class II proteins and MHC class II-like peptides.

12. The immunogenic composition according to claim 1, wherein the one or more MHC class I complexes and/or the MHC class II complexes further comprise antigenic peptide epitopes derived from HIV proteins selected from the group consisting of HIV-1 proteins and HIV-2 proteins.

13. The immunogenic composition according to claim 1, wherein the one or more biologically active molecules comprise as component i) one or more human MHC class I complexes and one or more human MHC class II complexes, comprise as component ii) one or more recombinant HIV-1gp 140 trimers comprising three copies of the amino acid sequence shown in SEQ ID NO:9583, and comprise as component iii) one or more heat shock proteins or fragments of heat shock proteins; and wherein each said component is attached to a multimerization domain comprising a soluble polysaccharide carrier molecule.

14. The immunogenic composition according to claim 1, wherein the one or more biologically active molecules comprise as component i) one or more human MHC class I complexes and one or more human MHC class II complexes, comprise as component ii) one or more recombinant HIV-1gp 140 trimers comprising three copies of the amino acid sequence shown in SEQ ID NO:9583 and one or more SIVp27 comprising the amino acid sequence shown in SEQ ID NO:9584), and comprise as component iii) one or more recombinant HSP70pep3Bio fragments comprising the amino acid sequence shown in SEQ ID NO 9582; and one or more MHC II-like peptides; wherein each said component is attached by biotin-streptavidin binding to a Dextran 270 multimerization domain, wherein the Dextran 270 has a molecular weight of about 270 kDa.

15. The immunogenic composition according to claim 2, wherein the one or more immunologically active molecules comprise a fragment of Hsp70.

16. The immunogenic composition according to claim 15, wherein the fragment of Hsp70 is a C-terminal fragment or a recombinant Hsp70pep3Bio fragment consisting of amino acid residues 359-609 of Hsp70 as shown in SEQ ID NO:9582.

17. The immunogenic composition according to claim 1, wherein the one or more HIV-derived proteins are recombinant trimers comprising three copies of an HIV-derived protein selected from the group consisting of gp41, gp 120, gp 140, gp27, and recombinant forms thereof.

18. The immunogenic composition according to claim 1, wherein the composition prevents HIV infection or decreases viral load when administered to a subject prior to exposure to HIV.

\* \* \* \* \*